United States Patent 11,446,398 (REGULATED BIOCIRCUIT SYSTEMS) - sequence listing, part 80

SEQ ID NO: 183633 - DNA, 3594 bp, Homo sapiens
  Payload ID: 16178
  Gene Symbol: SLC27A1
  Gene Name: solute carrier family 27 (fatty acid transporter), member 1
  Uniprot ID: Q6PCB7
  ENST ID: ENST00000252595
  CDS Start-End: 98-2038
gcggctcgctgtagaggcgggggcggtcgtggggcggagcgggtcgtggggcggggctggagcggcccgcggcctcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctggggttcaagtgatcctcccacctcagcctcctgagtagctgggattacaggcacccgccaccacgtccagctaatttttatatttttagtagagacggggtttcaccatgttggtcaggttggtcttgaactcctgacctcaggtgatccgctggcctcggcctcccagagtgctgggattataggcgtgagcctctggcccggcctttcctttttcctctcctctcctgccgagagtggaacacgcgtgtcctgggagctgcatcttgtgtagggtccagctgcttttggggactgcaggaatcatctcccctgggccctggactcggactggggcctccccacctccctctcggctgtgccttacggagccccgatccaggcctcctgtggctgttgggttccagatgctgcagctccatgtgacttccaagcaggccctccgccctccctgctgaatggaggagccgggggtcccccaggccaactggaaaatctcccaggctaggccaattgccttttgcacttccccgttcctgtcacatttccccagccccaccttcccctcctgatgccctgaaagcttccggaattgactgtgaccacttggatgtcaccactgtcagcccctgccttgatgtccccatttagccatctccatggagctcctgctggagggccctgaaccctgcactgcgtggctgcccagccagctgcctcctgtcctgggaggaggcctcctgggtgtcctcatctggtgtgtctactggagggtcccacaggagaggcagcagaggggtcaggggaggtctcctgccgggggttggcctctcaagcctcaggggttctagcctgttgaatataccccacctggtggtggcccctccgatgtccccactgatggctctgacaccgtgttggtggcgatgtcccagacaatcccaccaggacggcccagacatccctactggcttcgctggtggctcatctcgaacatccacgccagcctttctggggccggccacccaggccgcctgtccgtctgtcctccctccagcagcaccccctggcccctggagtggtggggccatggcaagagacaccgtggcgtctcatgtgaactttcctgggcactgtggttttatttcctaattgatttaagaaataaacctgaagaccgtc

SEQ ID NO: 183634 - DNA, 2596 bp, Homo sapiens
  Payload ID: 16178
  Gene Symbol: SLC27A1
  Gene Name: solute carrier family 27 (fatty acid transporter), member 1
  ENST ID: ENST00000599380
  CDS Start-End: 14-304
ctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtgcacaccggcagggccccggggcaggtctcggagttcagggaagaccactgtctcctcttcctggggcccctgggatacataaaacagcctggactggcgcggaaggctccgccaaggcgcacgcagggcggggtgtaaggggagttcctgggactcccggtgcaccaccagagggacaatcctgcagcctgcacagatagtcatgtgactgtggtccttgggtcaggagagttggaggataggtatggctgtgcgccctggcaagtgcctcagcctttctgagcctcagtttctgcgtgtggagattagcaaggagaatagggctctgtgtaccgtgctgttattttgttgttgttgtttgagacagagtctcgctctgtcgcccaggctggagtgcagccacgtgatcatagctcactgtagctttcagttcctgagctcaagcaatcctcctgcctcagcctcccaagtagcagcaaacagataccttcataattagcaactacttactctcttaatcatctccattctccgcttgcatgaatctccctctcctttcccaagcccctcccatccaaggccaagaacagaccgtaataatgatcataaagcaaatgtcggctgggcacagtggctcacacctgtaatcctaacactttgggaggctgaggcaggaggatcacttgagcccaggagtttgagaccagcatagccaatgtagtgagacccccttttctacagaaaataaaaaattagccaggcatggtggcaggtgcctgtagtcaatgctactaaggaggctgaggcgggaggatcacgtgagctcacgagatcgaggctgcagtgagctatgattacaccactggactccagcctgggcaacagagtgagactctgtgtctctaaaaaggaaaaaaaaaaacagcaagtgccatgggggctgggtccttaatgccaagaacaatgctccttcctcagtgtgcttggtgttggatggccagcccccagggcacttttgctcactgtagctcagattcttgcataggaaacacaccaggccaggcacggtggctcacgcctgtagggtccagccccacagggtcggtgggtttttctccctgtgtgcggagacgagagattgtagaaataaagacacaagacaaagagatgaaagaaaagacagctgggcccgggggaccactaccaccaagaggcggagaccggtagaggccccgaatgtctggctgcactgttatttactggatacaaagcaaaaggggcagggtaaagagtgtgagtcatctccaatgataggtaaggtcacgtgggtcatgcgtccactggacagggggcccttccctgcctggcagccgaggcagaggcagagagagggagagagagagaaagacagcttatgccattatttctgcatatcagagacttttagtactttcactaattttgctactgttatctagaaggcagagccaggtgtacaggatggaacatgaaggcggactaggagcatgaccactgaagcacagcatcacagggagacggttaggcctccggataactgtgggcaagcctgactgatgtcaggccctccacaagaggtggaggagtagagtcttctctaaactccccgggggaaagggagactccctttcccggtccactaagtagcaggtgtttttccttgacactaaggctaccgctagactagacttcccagacgctggcgtcaccgctagaccaaggaaccctctggtggccctgtccgggcataacagaaggctcgcactcttgtcttctggtcactactcactgtgtcccctcagctcctatctctctatggcccggttttttctaggttatgattacagagcgaggattattataatactggaataaagagtaattgctacaaa

SEQ ID NO: 183635 - DNA, 1163 bp, Homo sapiens
  Payload ID: 16178
  Gene Symbol: SLC27A1
  Gene Name: solute carrier family 27 (fatty acid transporter), member 1
  ENST ID: ENST00000600297
  CDS Start-End: 4-678
aggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcgggtgaggccaggcgtgggcatcaggtgggcggggacccaggactggcccctgggcgggcggggagatgctgcgccccaggcctcggaaggcggccgccctggacgtgggcatgaggtgcacggtctgggtatgccccgggcagggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaa

SEQ ID NO: 183636 - DNA, 788 bp, Homo sapiens
  Payload ID: 16178
  Gene Symbol: SLC27A1
  Gene Name: solute carrier family 27 (fatty acid transporter), member 1
  ENST ID: ENST00000599965
  CDS Start-End: 1-500
tgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttc

SEQ ID NO: 183637 - DNA, 1423 bp, Homo sapiens
  Payload ID: 16178
  Gene Symbol: SLC27A1
  Gene Name: solute carrier family 27 (fatty acid transporter), member 1
  ENST ID: ENST00000600277
  CDS Start-End: 244-918
aacgctggaaaggtcggccaaggagagcagaaaacaagcagtggtggagtcggcagtggggcagaggagggggagctggaagggaaggaccccaaagcagaagcccgcacagtaggcacagcgcacccaagaagggtccaggagtctgcagaaacagaaaggtccccggcctcagcctcctagtccctgcctgcctcctgcctgagcttctgggagactgaaggcacggcttgcagcttcaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcgggtgaggccaggcgtgggcatcaggtgggcggggacccaggactggcccctgggcgggcggggagatgctgcgccccaggcctcggaaggcggccgccctggacgtgggcatgaggtgcacggtctgggtatgccccgggcagggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcg

SEQ ID NO: 183638 - DNA, 2681 bp, Homo sapiens
  Payload ID: 16178
  Gene Symbol: SLC27A1
  Gene Name: solute carrier family 27 (fatty acid transporter), member 1
  Uniprot ID: Q6PCB7
  ENST ID: ENST00000598424
  CDS Start-End: 904-2307
gtggggcggggctggagcggcccgcggcctcagctctctctgcttccccaggatgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttgtcctgctcagatgccgcctgcctctctcaagggcctcccctgcctctgcccttggtccgtgtgactgaccacatcaccccttgcagtcttgtcaccatccagcacggcctggtattcagtcatatacatggaaggggtctctcttcccagaggactgtgaaccccagagggtggggcctggtggtctggatgctctgtccccagagctgagaacagtgcctaaagcacaacagacactgcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggggagttggtgcatcccaggcctcgggagggggcctgtccggcggtgaccatgacccatgtgttggggaccacagcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcactctgctgcccgggctagagtgcagtggtgggatctcggctcactgcaacctctgcctcctg

SEQ ID NO: 183639 - DNA, 2394 bp, Homo sapiens
  Payload ID: 16179
  Gene Symbol: SLC27A2
  Gene Name: solute carrier family 27 (fatty acid transporter), member 2
  Uniprot ID: O14975
  ENST ID: ENST00000267842
  CDS Start-End: 233-2095
agtcctgcccggaacccccggcaacgcgcatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggaagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtgagatggcactg

SEQ ID NO: 183640 - DNA, 2181 bp, Homo sapiens
  Payload ID: 16179
  Gene Symbol: SLC27A2
  Gene Name: solute carrier family 27 (fatty acid transporter), member 2
  Uniprot ID: O14975
  ENST ID: ENST00000380902
  CDS Start-End: 196-1899
acacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggaagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaa

SEQ ID NO: 183641 - DNA, 2025 bp, Homo sapiens
  Payload ID: 16179
  Gene Symbol: SLC27A2
  Gene Name: solute carrier family 27 (fatty acid transporter), member 2
  ENST ID: ENST00000544960
  CDS Start-End: 580-1737
ctttgctagaacttaatctgaatggctcatacaaggaggtgggaacctcagaagcccagaatgattcttttcattttgcatgtgaccctccatacactgacttgaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggatgccttcaactgtaagctgccccattatgagccactaagaagaaacactgccaattaacaatgttatgggaacactgctgtatggaagaagcaatattaagggtagcatgtgtactaggcattcttcaaggagctttacaacatttgttgataagattctgcccccactcttgacatcggtactctttttacttccattttagagattcagaaaatgatgcttagagaggttaagaacttcccaaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtg

SEQ ID NO: 183642 - DNA, 3351 bp, Homo sapiens
  Payload ID: 16180
  Gene Symbol: SLC27A3
  Gene Name: solute carrier family 27 (fatty acid transporter), member 3
  ENST ID: ENST00000271857
  CDS Start-End: 761-3196
aaaaggtctgtcatcctccagttgaagtctgtgtgcctaccaagaatggccggaggactcgctgcttgacgggagggatgctccagcttggtctccagggacaactgtacctggagataaagtctggataccagggagggacagagatgctcttccttccacagtgtggccacttgctgggccatgtgaaccagcagaggagagttccttggctatgctgttgttcccccgctgtccagggagaatggaggtggactgaggagtgaagtttgggcgaactgcacagagctgctcctcttcaccccgaaaatttgtctttttacagaatccaggttctcccctccctcatcactgctgttgcttcctttgaaagtctaaaccactggaggcttctttttccttcctctctccttccccagtttcctctgtcccaattaaaaccaggatggagagcatttgctggctggccccaattattgtacccttgcccaaagggaggggcctctgtcgtgacccctcagaaatctggcagtctgggtttccacctttcccctatttaactctcagcccccacccatcccctggggttgcggctggcaggccgggacttgcagaaccaaatgggccaggggccaagttcattcttttgggagagagcaatggtaccttcccttaacgggaaaacgagaaatattgaggggaagatggactgcgatccaaacgccctggctctcaggcctggactctagggcttagccagatgcctaaaccgcccaagccgagaaacaacttagaagacagacataaccctgggattcagggaaggcgcgagcaccgcccaggacctggtagggtgcgagccgcgagcagtccgggagggagcgcgcctagggcggagcgtaggctgtggggggagggctgggagtccggggccgccccacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctaca

SEQ ID NO: 183643 - DNA, 2410 bp, Homo sapiens
  Payload ID: 16180
  Gene Symbol: SLC27A3
  Gene Name: solute carrier family 27 (fatty acid transporter), member 3
  Uniprot ID: Q5K4L6
  ENST ID: ENST00000368661
  CDS Start-End: 66-2258
cacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacct

SEQ ID NO: 183644 - DNA, 1357 bp, Homo sapiens
  Payload ID: 16180
  Gene Symbol: SLC27A3
  Gene Name: solute carrier family 27 (fatty acid transporter), member 3
  ENST ID: ENST00000458027
  CDS Start-End: 1-1202
cccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctaca

SEQ ID NO: 183645 - DNA, 433 bp, Homo sapiens
  Payload ID: 16180
  Gene Symbol: SLC27A3
  Gene Name: solute carrier family 27 (fatty acid transporter), member 3
  ENST ID: ENST00000532853
  CDS Start-End: 1-433
gtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccc

SEQ ID NO: 183646 - DNA, 457 bp, Homo sapiens
  Payload ID: 16180
  Gene Symbol: SLC27A3
  Gene Name: solute carrier family 27 (fatty acid transporter), member 3
  ENST ID: ENST00000524676
  CDS Start-End: 1-457
caattcgggacccccaggggcactgtatggccacatctccagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagg

SEQ ID NO: 183647 - DNA, 3351 bp, Homo sapiens; identical to SEQ ID NO: 183642
  Payload ID: 16180
  Gene Symbol: SLC27A3
  Gene Name: solute carrier family 27 (fatty acid transporter), member 3
  ENST ID: ENST00000575439
  CDS Start-End: 761-3196

SEQ ID NO: 183648 - DNA, 457 bp, Homo sapiens; identical to SEQ ID NO: 183646
  Payload ID: 16180
  Gene Symbol: SLC27A3
  Gene Name: solute carrier family 27 (fatty acid transporter), member 3
  ENST ID: ENST00000575532
  CDS Start-End: 1-457

SEQ ID NO: 183649 - DNA, 1357 bp, Homo sapiens; identical to SEQ ID NO: 183644
  Payload ID: 16180
  Gene Symbol: SLC27A3
  Gene Name: solute carrier family 27 (fatty acid transporter), member 3
  ENST ID: ENST00000570870
  CDS Start-End: 1-1202

SEQ ID NO: 183650 - DNA, 433 bp, Homo sapiens; identical to SEQ ID NO: 183645
  Payload ID: 16180
  Gene Symbol: SLC27A3
  Gene Name: solute carrier family 27 (fatty acid transporter), member 3
  ENST ID: ENST00000573411
  CDS Start-End: 1-433

SEQ ID NO: 183651 - DNA, 2413 bp, Homo sapiens
  Payload ID: 16180
  Gene Symbol: SLC27A3
  Gene Name: solute carrier family 27 (fatty acid transporter), member 3
  Uniprot ID: Q5K4L6
  ENST ID: ENST00000624995
  CDS Start-End: 66-2258
cacacccgcactcctcccgggtttctgctctccgcccgtgtggagtggtgggggcctgggtgggaatgggcgtgtgccagcgcacgcgcgctccctggaaggagaagtctcagctagaacgagcggccctaggttttcggaagggaggatcagggatgtttgcgagcggctggaaccagacggtgccgatagaggaagcgggctccatggctgccctcctgctgctgcccctgctgctgttgctaccgctgctgctgctgaagctacacctctggccgcagttgcgctggcttccggcggacttggcctttgcggtgcgagctctgtgctgcaaaagggctcttcgagctcgcgccctggccgcggctgccgccgacccggaaggtcccgaggggggctgcagcctggcctggcgcctcgcggaactggcccagcagcgcgccgcgcacacctttctcattcacggctcgcggcgctttagctactcagaggcggagcgcgagagtaacagggctgcacgcgccttcctacgtgcgctaggctgggactggggacccgacggcggcgacagcggcgaggggagcgctggagaaggcgagcgggcagcgccgggagccggagatgcagcggccggaagcggcgcggagtttgccggaggggacggtgccgccagaggtggaggagccgccgcccctctgtcacctggagcaactgtggcgctgctcctccccgctggcccagagtttctgtggctctggttcgggctggccaaggccggcctgcgcactgcctttgtgcccaccgccctgcgccggggccccctgctgcactgcctccgcagctgcggcgcgcgcgcgctggtgctggcgccagagtttctggagtccctggagccggacctgcccgccctgagagccatggggctccacctgtgggctgcaggcccaggaacccaccctgctggaattagcgatttgctggctgaagtgtccgctgaagtggatgggccagtgccaggatacctctcttccccccagagcataacagacacgtgcctgtacatcttcacctctggcaccacgggcctccccaaggctgctcggatcagtcatctgaagatcctgcaatgccagggcttctatcagctgtgtggtgtccaccaggaagatgtgatctacctcgccctcccactctaccacatgtccggttccctgctgggcatcgtgggctgcatgggcattggggccacagtggtgctgaaatccaagttctcggctggtcagttctgggaagattgccagcagcacagggtgacggtgttccagtacattggggagctgtgccgataccttgtcaaccagcccccgagcaaggcagaacgtggccataaggtccggctggcagtgggcagcgggctgcgcccagatacctgggagcgttttgtgcggcgcttcgggcccctgcaggtgctggagacatatggactgacagagggcaacgtggccaccatcaactacacaggacagcggggcgctgtggggcgtgcttcctggctttacaagcatatcttccccttctccttgattcgctatgatgtcaccacaggagagccaattcgggacccccaggggcactgtatggccacatctccaggtgagccagggctgctggtggccccggtaagccagcagtccccattcctgggctatgctggcgggccagagctggcccaggggaagttgctaaaggatgtcttccggcctggggatgttttcttcaacactggggacctgctggtctgcgatgaccaaggttttctccgcttccatgatcgtactggagacaccttcaggtggaagggggagaatgtggccacaaccgaggtggcagaggtcttcgaggccctagattttcttcaggaggtgaacgtctatggagtcactgtgccagggcatgaaggcagggctggaatggcagccctagttctgcgtcccccccacgctttggaccttatgcagctctacacccacgtgtctgagaacttgccaccttatgcccggccccgattcctcaggctccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctaca

SEQ ID NO: 183652 - DNA, 2413 bp, Homo sapiens; identical to SEQ ID NO: 183651
  Payload ID: 16180
  Gene Symbol: SLC27A3
  Gene Name: solute carrier family 27 (fatty acid transporter), member 3
  Uniprot ID: Q5K4L6
  ENST ID: ENST00000623839
  CDS Start-End: 66-2258

SEQ ID NO: 183653 - DNA, 3028 bp, Homo sapiens
  Payload ID: 16181
  Gene Symbol: SLC27A4
  Gene Name: solute carrier family 27 (fatty acid transporter), member 4
  Uniprot ID: Q6P1M0
  ENST ID: ENST00000300456
  CDS Start-End: 118-2049
gctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcgcgatatctttggcggcctggtcctcctgaaggtgaaggcaaaggtgcgacagtgcctgcaggagcggcggacagtgcccattttgtttgcctctaccgttcggcgccaccccgacaagacggccctgatcttcgagggcacagatacccactggaccttccgccagctggatgagtactcaagcagtgtagccaacttcctgcaggcccggggcctggcctcgggcgatgtggctgccatcttcatggagaaccgcaatgagttcgtgggcctatggctgggcatggccaagctcggtgtggaggcagccctcatcaacaccaacctgcggcgggatgctctgctccactgcctcaccacctcgcgcgcacgggcccttgtctttggcagcgaaatggcctcagccatctgtgaggtccatgccagcctggacccctcgctcagcctcttctgctctggctcctgggagcccggtgcggtgcctccaagcacagaacacctggaccctctgctgaaagatgctcccaagcaccttcccagttgccctgacaagggcttcacagataaactgttctacatctacacatccggcaccacagggctgcccaaggccgccatcgtggtgcacagcaggtattaccgcatggctgccctggtgtactatggattccgcatgcggcccaacgacatcgtctatgactgcctccccctctaccactcagcaggaaacatcgtgggaatcggccagtgcctgctgcatggcatgacggtggtgattcggaagaagttctcagcctcccggttctgggacgattgtatcaagtacaactgcacgattgtgcagtacattggtgaactgtgccgctacctcctgaaccagccaccgcgggaggcagaaaaccagcaccaggttcgcatggcactaggcaatggcctccggcagtccatctggaccaacttttccagccgcttccacataccccaggtggctgagttctacggggccacagagtgcaactgtagcctgggcaacttcgacagccaggtgggggcctgtggtttcaatagccgcatcctgtccttcgtgtaccccatccggttggtacgtgtcaacgaggacaccatggagctgatccgggggcccgacggcgtctgcattccctgccagccaggtgagccgggccagctggtgggccgcatcatccagaaagaccccctgcgccgcttcgatggctacctcaaccagggcgccaacaacaagaagattgccaaggatgtcttcaagaagggggaccaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtcctcctagcctgtgtgcaaaccacccaagcccaccctgaccccagaaccccacagccccactgtggccgcttgatcccccacgccaaccccctggcccattgacccgcctcatctgttcattcacttatctaagctgagggtgtagcaggtaagatgccgcagcccctgcctccaatgtgctggttcagccgggggcagtgcccatgtgaatctggcaaggtgtttaacagtgtgggcttgaaagtccaaacca

SEQ ID NO: 183654 - DNA, 1557 bp, Homo sapiens
  Payload ID: 16181
  Gene Symbol: SLC27A4
  Gene Name: solute carrier family 27 (fatty acid transporter), member 4
  Uniprot ID: Q6P1M0
  ENST ID: ENST00000372870
  CDS Start-End: 118-831
ggagcgcggcgggcggggccgggcggcgggcggggctggcggggcggccgggccatgcagggcgcagagccggctaaaccctgctgagacccggctccgtgcgtccaggggcggctaatgcccctcacgctgtctacgctgctgcaaccgggccgcatctggacggggcgccgcgcggcggagccgacgccgggccacaatgctgcttggagcctctctggtgggggtgctgctgttctccaagctggtgctgaaactgccctggacccaggtgggattctccctgttgttcctctacttgggatctggcggctggcgcttcatccgggtcttcatcaagaccatcaggcctaccttactggtgatgtgctggtgatggacgagctgggctacctgtacttccgagaccgcactggggacacgttccgctggaaaggtgagaacgtgtccaccaccgaggtggaaggcacactcagccgcctgctggacatggctgacgtggccgtgtatggtgtcgaggtgccaggaaccgagggccgggccggaatggctgctgtggccagccccactggcaactgtgacctggagcgctttgctcaggtcttggagaaggaactgcccctgtatgcgcgccccatcttcctgcgcctcctgcctgagctgcacaaaacaggaacctacaagttccagaagacagagctacggaaggagggctttgacccggctattgtgaaagacccgctgttctatctagatgcccagaagggccgctacgtcccgctggaccaagaggcctacagccgcatccaggcaggcgaggagaagctgtgattccccccatccctctgagggccggcggatgctggatccggagccccaggttccgccccagagcggtcctggacaaggccagaccaaagcaagcagggcctggcacctccatcctgaggtgctgcccctccatccaaaactgccaagtgactcattgccttcccaacccttccagaggctttctgtgaaagtctcatgtccaagttccgtcttctgggctgggcaggccctctggttcccaggctgagactgacgggttttctcaggatgatgtcttgggtgagggtagggagaggacaaggggtcaccgagcccttcccagagagcagggagcttataaatggaaccagagcagaagtccccagactcaggaagtcaacagagtgggcagggacagtggtagcatccatctggtggccaaagagaatcgtagccccagagctgcccaagttcactgggctccacccccacctccaggaggggaggagaggacctgacatctgtaggtggcccctgatgccccatctacagcaggaggtcaggaccacgcccctggcctctccccactcccccatcctcctccctgggtggctgcctgattatccctcaggcagggcctctcagtccttgtgggtctgtgtcacctccatctcagtcttggcctggctatgaggggaggaggaatgggagagggggctcaggggccaataaactctgccttgagtc

SEQ ID NO: 183655 - DNA, 2361 bp, Homo sapiens
  Payload ID: 16182
  Gene Symbol: SLC27A5
  Gene Name: solute carrier family 27 (fatty acid transporter), member 5
  Uniprot ID: Q9Y2P5
  ENST ID: ENST00000263093
  CDS Start-End: 111-2183
agcagtgccagggccaccacccctggggaggagccattgggctactcttgaggggccagaggtgagcctgaacactccacagctgctgctcctagggaggagctggtaccatgggtgtcaggcaacagttggccttgctgctgctgctgctgctcctgctctggggcctggggcagccagtgtggccagtcgctgtggccttgaccctgcgctggctcctgggggatcccacatgttgcgtgctacttgggctggccatgttagcacggccctggctcggcccctgggtgccccatgggctgagcctggcagctgcggccctggcactaaccctcctgccagcacggctgcccccaggactacgctggctgccggctgatgtgatcttcttggccaagatcctccacctgggcctgaagatcaggggatgcttgagccggcagccgcctgacacctttgtagatgccttcgagcggcgagcacgagcgcagcctggcagggcactcttggtgtggacggggcctggggccggctcagtcacctttggtgagctggatgcccgggcctgccaggcggcatgggccctgaaggctgagctgggtgaccctgcgagcctgtgtgccggggagcctactgccctccttgtgctggcttcccaggccgttccagccctgtgtatgtggctggggctggccaagctgggctgcccaacagcctggatcaacccgcatggccgggggatgcccctggcgcactctgtgctgagctctggggcccgggtgctggtggtggacccagacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactggcctcccgaagccagccatcctcacgcatgagcgggtactgcagatgagcaagatgctgtccttatctggggccacagctgatgatgtggtttacacggtcctgcctctgtaccacgtgatgggacttgtcgttgggatcctcggctgcttagatctcggagccacctgtgttctggcccccaagttctctacttcctgcttctgggatgactgtcggcagcatggcgtgacagtgatcctgtatgtgggcgagctcctgcggtacttgtgtaacattccccagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcac

SEQ ID NO: 183656 - DNA, 2003 bp, Homo sapiens
  Payload ID: 16182
  Gene Symbol: SLC27A5
  Gene Name: solute carrier family 27 (fatty acid transporter), member 5
  ENST ID: ENST00000595851
  CDS Start-End: 162-449
cttcccgggggcgtggtcacaagcgccggctccctccttgcagatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactgggacagggtctcatcctgttgcccaggctggagtgcaatggtgttatcagagctcactgcagccttaacctcctgggctcaagtgattctcccacctcagtctccctgggactacagggagcaggagaaacggaagccaactgtgctttcctgggtcttctgctgctctccacactgagacctcaggcccagcctctgcacagacgagtgggaaggcacagtttttgaacacccacctgagagtcttctgctggtgccccagaggctgtatccaggccccgagaacaccgaggccccgagggactgtgctgtctggctgctcatggaacctccggccggtggcccttgcggtggatgaccagctgcgacttccagtcgaaggcgcggccacagtcactgcagaagtgacgccgctggcctgtgtggctcttgcggtggatgaccagctgcgacttccagctgaagctgcacccgcactcctcacacgggtaactccgggggcctgtgagtgagcgtcgggggtggtgcggaaaggccacctccccttgtggtggcttctctgtgctttccccggtggctagccccggggactgcacacctggcccactcgtgtgtgtccggtggtggatgacgaacactgacttccagtcgaagccgcggccacactgctcgcacgtgtagggcttcctgggggtggcagccggctccagtctcgtctctgcaggtgtgggctgagtgggcactggcggtgtccctgggcgcacagtgggggcaggagtggcagccccagacaagccctcccaggctgccggccctgggccctggggcggctgggcctctgggcagccaggtggaccctcactctcatttcctgggggcaggggcaaaccaggtgagtcccggcactcagcaacccctccctcaggcttgtggccgtggcacaagctcccgtccccccatgagtgggtggctcaggtcccaccgatacaggaggggtgattcaggctggatggtgtggggcactcacccgagcgcaggcttctgcagacgcctgtccccgtgagcagcatccccagctctgactgggcctgtgcctctggctggtggggcggtaaccctgcccgggtggggggcacagttaggcatggggtttgcatgaaggaggggtggggtcggttctggtaggtgacagggtgttcctctggaaggtgggagagctgggtagggctggtagcacagaggccctgcccagctaggcctgctgcagggtgggtgcaggccccagggagaggggcggggtggggctggctggtcctcacccagggagaccactgtgccgtacttctccagcatcgcatcccagtacagttccttctgtgaccggtccagcagcccccactcctcctgcggatgtggcccatcactgtaggcgtctttccaccccttccctgccctgtctggttcacattcttacctattacccggaagagtcagcaggttacctacgcctcatctgcccctcctgctgagaatga

SEQ ID NO: 183657 - DNA, 1987 bp, Homo sapiens
  Payload ID: 16182
  Gene Symbol: SLC27A5
  Gene Name: solute carrier family 27 (fatty acid transporter), member 5
  Uniprot ID: Q9Y2P5
  ENST ID: ENST00000601355
  CDS Start-End: 38-1858
actccacagctgctgctcctagggaggagctggtaccatgggtgtcaggcaacagttggccttgctgctgctgctgctgctcctgctctggggcctggggcagccagtgtggccagtcgctgtggccttgaccctgcgctggctcctgggggatcccacatgttgcgtgctacttgggctggccatgttagcacggccctggctcggcccctgggtgccccatgggctgagcctggcagctgcggccctggcactaaccctcctgccagcacggctgcccccaggactacgctggctgccggctgatgtgatcttcttggccaagatcctccacctgggcctgaagatcaggggatgcttgagccggcagccgcctgacacctttgtagatgccttcgagcggcgagcacgagcgcagcctggcagggcactcttggtgtggacggggcctggggccggctcagtcacctttgacctccgggagagcctggaggagatccttcccaagctgcaggctgagaacatccgctgcttctacctcagccatacctcccctacaccaggggtgggggctctgggggctgccctggatgcagcgccctcccacccagtgcctgctgacctgcgtgctgggatcacatggagaagccctgccctcttcatctatacctcggggaccactggcctcccgaagccagccatcctcacgcatgagcgggtactgcagatgagcaagatgctgtccttatctggggccacagctgatgatgtggtttacacggtcctgcctctgtaccacgtgatgggacttgtcgttgggatcctcggctgcttagatctcggagccacctgtgttctggcccccaagttctctacttcctgcttctgggatgactgtcggcagcatggcgtgacagtgatcctgtatgtgggcgagctcctgcggtacttgtgtaacattccccagcaaccagaggaccggacacatacagtccgcctggcaatgggcaatggactacgggctgatgtgtgggagaccttccagcagcgcttcggtcctattcggatctgggaagtctacggctccacagaaggcaacatgggcttagtcaactatgtggggcgctgcggggccctgggcaagatgagctgcctcctccgaatgctgtccccctttgagctggtgcagttcgacatggaggcggcggagcctgtgagggacaatcagggcttctgcatccctgtagggctaggggagccggggctgctgctgaccaaggtggtaagccagcaacccttcgtgggctaccgcggcccccgagagctgtcggaacggaagctggtgcgcaacgtgcggcaatcgggcgacgtttactacaacaccggggacgtactggccatggaccgcgaaggcttcctctacttccgcgaccgcctcggggacaccttccgatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaa

SEQ ID NO: 183658 - DNA, 643 bp, Homo sapiens
  Payload ID: 16182
  Gene Symbol: SLC27A5
  Gene Name: solute carrier family 27 (fatty acid transporter), member 5
  ENST ID: ENST00000594786
  CDS Start-End: 174-461
gcggggcctctccttcccgggggcgtggtcacaagcgccggctccctccttgcagatggaagggcgagaacgtgtccacgcacgaggtggagggcgtgttgtcgcaggtggacttcttgcaacaggttaacgtgtatggcgtgtgcgtgccaggttgtgagggtaaggtgggcatggctgctgtgcagctagcccccggccagactttcgacggggagaagttgtaccagcacgttcgcgcttggctccctgcctacgctaccccccatttcatccgcatccaggacgccatggaggtcaccagcacgttcaaactgatgaagacccggttggtgcgtgagggcttcaatgtggggatcgtggttgaccctctgtttgtactggacaaccgggcccagtccttccggcccctgacggcagaaatgtaccaggctgtgtgtgagggaacctggaggctctgatcacctggccaacccactggggtagggatcaaagccagccacccccaccccaacacactcggtgtccctttcatcctgggcctgtgtgaatcccagcctggccataccctcaacctcagtgggctggaaatgacagtgggccctgtagcagtggcagaataaactcagatgtgttcacagaa

SEQ ID NO: 183659 - DNA, 3219 bp, Homo sapiens
  Payload ID: 16183
  Gene Symbol: SLC27A6
  Gene Name: solute carrier family 27 (fatty acid transporter), member 6
  Uniprot ID: Q9Y2P4
  ENST ID: ENST00000262462
  CDS Start-End: 1011-2870
gggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttact

SEQ ID NO: 183660 - DNA, 2616 bp, Homo sapiens
  Payload ID: 16183
  Gene Symbol: SLC27A6
  Gene Name: solute carrier family 27 (fatty acid transporter), member 6
  Uniprot ID: Q9Y2P4
  ENST ID: ENST00000395266
  CDS Start-End: 397-2256
gacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatatttta

SEQ ID NO: 183661 - DNA, 2294 bp, Homo sapiens
  Payload ID: 16183
  Gene Symbol: SLC27A6
  Gene Name: solute carrier family 27 (fatty acid transporter), member 6
  Uniprot ID: Q9Y2P4
  ENST ID: ENST00000506176
  CDS Start-End: 435-2294
gagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaa

SEQ ID NO: 183662 - DNA, 811 bp, Homo sapiens
  Payload ID: 16183
  Gene Symbol: SLC27A6
  Gene Name: solute carrier family 27 (fatty acid transporter), member 6
  ENST ID: ENST00000508645
  CDS Start-End: 326-811
ccgtgcgctccgaagacggatattggaaagctgcaaaagtcaccagaaagaaacagggctgccttagtaaagtacagaggtgaagtggagcaagatggcagaatagcaagctcctttgatggccatccgcacaaatgtctacacagaaaaagcaccttcacaagaaccaaaaatcagcctgttttgtgcaacttccaagtcaagattatgaacattttcagactttttgcaagacagaattcaatggattaacaatcagccttatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgat

SEQ ID NO: 183663 - DNA, 2636 bp, Homo sapiens
  Payload ID: 16184
  Gene Symbol: SLC28A1
  Gene Name: solute carrier family 28 (concentrative nucleoside transporter), member 1
  Uniprot ID: O00337
  ENST ID: ENST00000286749
  CDS Start-End: 91-2040
ataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaagggttcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgttta

SEQ ID NO: 183664 - DNA, 1360 bp, Homo sapiens
  Payload ID: 16184
  Gene Symbol: SLC28A1
  Gene Name: solute carrier family 28 (concentrative nucleoside transporter), member 1
  Uniprot ID: O00337
  ENST ID: ENST00000338602
  CDS Start-End: 231-758
agggcccacaacgatgtgaaggttataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagagggatcccaggccatggagcaaggagggcccgaatcagtacctccctcagatcacctggacagtgtgagacaaaaagccgcagggaccatccctggagggggattcagcaggctcgatcggggtccaggtgctggtatttttcattagcctccaggggattctgatgtagccagcagcgtccttggacaacagtttgagatctgctgcttttcaaactggattccttggagcgctggaaatctcagcgatgtcacagggcaggagagggaggttgtggagggaaaattcagacttcccgcccagcccaccatttcaccaggcagctctaaatttatgtgttttataagccaaggttcacacaaaaaagaaaattcgctgggggaaaaaaacagtttctatggcttaaaaaaaagtctgaagaccaccagtctatttcaatactctattttgttgatgaagaagctggtgaccaaagatacccaaagactaagtcagggggatgcaggggtacaggggtgcctctcactttcccaaagtgagatccacataccacagcaaaatgatttgagccagcctgtggatgaacacatttaaaattttatttataaatacatttactgttacatttgacttctctttattaaatacatttgtgatttatttttgcaa

SEQ ID NO: 183665 - DNA, 2769 bp, Homo sapiens
  Payload ID: 16184
  Gene Symbol: SLC28A1
  Gene Name: solute carrier family 28 (concentrative nucleoside transporter), member 1
  Uniprot ID: O00337
  ENST ID: ENST00000394573
  CDS Start-End: 224-2173
acaacgatgtgaaggttataagctgcactgcatggttgctgctggatgtgttgtgttcctggcttccctctggatgctgacagaaacaagggaatttctgctgaagtgacaaggcaagccagagccaaagcaggttggacccagcttgtccccacagagacgtgtgcttccctctctctctgagagcgacctgttaaccgcaaatacctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaagggttcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgttta

SEQ ID NO: 183666 - DNA, 2155 bp, Homo sapiens
  Payload ID: 16184
  Gene Symbol: SLC28A1
  Gene Name: solute carrier family 28 (concentrative nucleoside transporter), member 1
  ENST ID: ENST00000538177
  CDS Start-End: 108-1559
acaacgatgtgaaggttataagctgcactgcatggttgctgctggatgtgttgtgttcctggcttccctctggatgctgacagaaacaaggctggaaggtctgggacatggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttggggtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagcgtcaatccagagttcagcccagaggccctggacaactgctgtcggttttacaaccacacgatctgtgcacagtgaggacagaacatgcttgtgcttctgcgcttctgagggctgttctcccccgggaaccatctgtccccaccttccctttcccagagccctcttcagggaagccacaggacttagacccagctcaatcccacaattgggaagggttcatggagtgagtgtgcagagagtgagtgaggacataaggaaggacatgtcccactccatcccccttcctgctcccccatttcctaactcccccagtgtgaattctcagggtcacttctgcctcctcccgtttcccctccacatccaaacagcaccctggtcctctctatcccccctctcctggggtccctcacatgccccttcccttctgttgtgggctgcacaccaaagcctcctcccctccccacttcctaggcactaggatctctctgtggcttcccctgctgggtggtgtcacctctttctctgctttcagagaaacccttcccgcctttcctcagagtgcttcccaaactgaggtcccatggcacactgtcctgggaggcgttcagagggttccatgatggactaggtttggaaccactgggttaaataaacttagagagggctgttta

SEQ ID NO: 183667 - DNA, 4374 bp, Homo sapiens
  Payload ID: 16185
  Gene Symbol: SLC28A2
  Gene Name: solute carrier family 28 (concentrative nucleoside transporter), member 2
  Uniprot ID: O43868
  ENST ID: ENST00000347644
  CDS Start-End: 66-2042
tttcagtccttcactgaggagccagagggaatcaattccacaagctgggttgaggagaacaggagatggagaaagcaagtggaagacagtccattgctctgtccacagtggagactggcacagtgaacccggggctggagctcatggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggaggagtccaagttcaagagtgaggagggggtaaagctgccccgtgggaaggagaggaatgtcctggaagctgccagcaacggagccgtagatgccataggccttgctactaatgtagcagccaacctgattgcctttttggctgtgttggccttcatcaatgctgccctctcctggctgggggaattggtggacatacaggggctcactttccaggtcatctgctcctatctcctaaggcccatggttttcatgatgggtgtagagtggacagactgtccaatggtggctgagatggtgggaatcaagttcttcataaatgagtttgtggcttatcagcaactgtctcaatacaagaacaaacgtctctctggaatggaggagtggattgagggagagaaacagtggatttctgtgagagctgaaatcattacaacattttcactctgtggatttgccaatcttagttccataggaatcacacttggaggcttgacatcaatagtacctcaccggaagagtgacttgtccaaggttgtggtcagggccctcttcacaggggcctgtgtatcccttatcagtgcctgtatggcaggaatcctctatgtccccaggggagctgaagctgactgtgtctccttcccaaacacaagtttcaccaatagaacctatgagacctacatgtgctgcagagggctctttcagagtacttctctgaatggcaccaaccctccttctttttctggtccctgggaagataaggagttcagtgctatggcccttactaactgctgtggattctacaacaataccgtctgtgcctaaggctgcttgatctatttctataacagttttgatcttaaaagctttgtgattgcaaaggtgtttatgtactcagggtgcccacaactcactcaccaagatgtttaacagtaagtaacagtaaatgtaaaagattcattttgggccgggctcagtggctcatgcctgtaatcccagcactttgggaggccgaggcgggcggatcacaaggtcaggagatcgagaccatcctggctaacacagtgaaaccccgtctctactaaaaatacaaaaaattagccgggagtggtgtcgggcgactgtagtcccagctactcgcgaggctgaggcaggagaatggcgtgaatccgggaggcggagcttgcagcgagccaagatcgcgccactgcactccagcctgggtgacagagcgagactctgtctcaaaaaaaaaaaaaaaaaaaaagattcattttggttcgctgtatcccaataacgaaaaatagcttttgtttttccattatttggctgaaccaaaaaatggcattcctcatgggccctgcctgaactttcatttgaaaaaataagtattactgtccaacaatgatagactggattaagaaaatgtggcacatatacaccatggaatactatgcagccataaaaaatgatgagctcatgtcctttgcagggacatggatgaaattggaaatcatcattctcagtaaactatcgcaaggacaaaaaaccaaacaccacatgttctcactcatagatgggaattgaacaatgagaacacatggacacaggaaggggaacatcacactctggggactgttgtggggtgaggggaagggggagggatagcattaggagatatacctaatgctaaatgacgagttaatgggtgcagcacactagcatggcacatgtatacatatgtaactaacctgcatattgtgcacatgtaccctaaaacttaaagtataataataataataaaagaaaaaacttcataaaataaagtgaagcacccaccaaaaaataaaataaataaaataaataaataaaagaaaaaataagtattactatgtcaaaaaagtcttacaaatcatgcttctagttgccatcttaaaaattatgtgatgcagtgtgctataaatgtgatttagtatgtaatttgcctgggacgggggagaagctacatttattggcattgtggatgagctggatttatattactgatgttacctttgaaaggtatatgaatatttaatgataagatttttctggttgtcaaacatttgtaaatctgcaaacttcttaacaacattacacagtaaacaaaaaatacttcctgtatactaaggaagacttctaaggaatatccatttcttaaaggccattactttgttgtagtattctgctttagtgctagccacatttgctccaagtttatggggaagcctttaaaacagtaattttcagtgggaaggggccaattttgcttttcagaggacatctgacagtgtgtctccagacattattggtgattaaagtgggaggatgctactgacatctagtgagtagaggccaatattgctactaaaattcctataaccaaaggtcagctctcccacaacgaagaattacctggtcccaaacgtcaattgtgctgagactcagaaactctgattcaaaatattttagatatttattatatttaatattatttattatattaatattatagccttaaggaagggtttcaaaaggatacaggagttcctcaaaaagttaaacacagaattaccatagagccccacaattccactcctacatacacattcaaaagaatcaaaactaagttctcaaacaagtacatgtacatgcatgttcacagtagcactattcaaaatagccaaaaattggaaacagtctaaatgtccatcaatggataaattgtgttacatacacacaatggaattttattcacccattaaaaaaagaagtactgatttatgctatgtagaggcaccccgaaaacatgctaaacgaaagaagctagacacaaaagtcttattattgcatgattccatttagatgaaatattcagaatatataaatccatagagacagaagggagatggtggttgccagggcctggggaaggagggattagagagtgactccttaacgagtttggggttttcctttggggtgatgggaatgttttggaacgagatagaggtggtggttgtgcaacattgtgaatattatgtcactgaattgttcactttaaaatggctgtttatgttatgtgaatttcacctcaataaaaaaaatttttagaagg

SEQ ID NO: 183668 - DNA, 769 bp, Homo sapiens
  Payload ID: 16185
  Gene Symbol: SLC28A2
  Gene Name: solute carrier family 28 (concentrative nucleoside transporter), member 2
  ENST ID: ENST00000559924
  CDS Start-End: 1-215
cctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatggtgtcctggaggacagtgttttcgggcctaggtcttcaatttgtctttgggatcttggtcatcagaactgatcttggatatactgtatttcagtggctgggagagcaggtccagattttcctgaactacactgtggccggctccagttttgtctttggggatacactggtcaaggatgtctttgcttttcaggccttaccaatcatcattttctttggatgtgtggtgtccattctctactacctgggccttgtgcaatgggtagttcagaaggtttctgtattcttctaggtcgcctggtttttacaaatcactatgggcaccactgctacagagaccctggctgtggcaggaaacatctttgtgggtatgacagaggcacctctgctcatccgtccctaccttggggacatgacactctctgaaatccatgcggtgatgactggagggtttgccaccatttctggcactgtgctgggagccttcatagcctttggggttgatgcatcatccctgatttctgcctctgtgatggccgccccttgtgctctcgcctcatcaaagctagcgtatccggaagtggag

SEQ ID NO: 183669 - DNA, 581 bp, Homo sapiens
  Payload ID: 16185
  Gene Symbol: SLC28A2
  Gene Name: solute carrier family 28 (concentrative nucleoside transporter), member 2
  ENST ID: ENST00000560438
  CDS Start-End: 1-581
agtccttcactgaggagccagagggaatcaattccacaagctggggaaaaagaagtagagcctgagggaagcaagaggactgacgcacaaggacacagcctgggggatggactgggcccttccacttaccagaggaggagtcggtggcctttcagcaaagcaagaagtttctgcaaaacacacgccagcttgttcaagaagatcctgttgggcctgttgtgtttggcctatgctgcctatctcctggcagcttgcatcttgaatttccagagggcactggccttgtttgtcatcacctgcttggtgatctttgtcctggttcactcgtttttgaaaaagctcctgggcaaaaaattaacaagatgtctgaagccctttgaaaactcccgcctgaggctttggacgaaatgggtgtttgcaggagtctccttggttggccttatactgtggttggctttagacacagcccaaaggccagagcagctgatcccctttgcaggaatctgcatgttcatccttatcctctttgcctgctccaaacaccacagcgcagtgtcctggaggacagtgttttcgggcct

SEQ ID NO: 183670 - DNA, 4887 bp, Homo sapiens
  Payload ID: 16186
  Gene Symbol: SLC28A3
  Gene Name: solute carrier family 28 (concentrative nucleoside transporter), member 3
  Uniprot ID: Q9HAS3
  ENST ID: ENST00000376238
  CDS Start-End: 51-2126
cccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataatggaatcagctttaattgcaaggaatgaagaaaaacaagagtggaccttcaaagctacaacattttcctcctcccctccctccccaccagccccttccccaccaagaactgctatgatgtcccaaagtgaggtgttgttgattccagtctcaatgggattttctgactttaatgtttgcaaggcatttcaccagaatacagctataaacggccgctcccaacaactgggctctgactcacccacacccacttagtgtccactaagtagtccagggtgactcagtttaagcacatctcaggtgaggtcactctgcatataccttggcttacctgaaatagcctgaacttgaatctcacataagggaaaactagtcatcaatcaccaactcattgactaccctcaggaagtcctgcagaaatcaagagtccttgaggagaacacgtggatcataccaaaaccagggtttaaatccattctgcttaagagttctatcagtcagtttaaccataaattacgctacagaaacaaacaacccaaaaacctcagtggcttacagatttatttttcactcacatgtttgtaatgatccatcttggttgtaatccatattgcttcagcacccagtctaaaggagcagcctctaaggggggcatgttggtcttaagagggaaaagaaaggtgggaaccacatgatggctctttcatcttccgctaggaaatgataccctttacttccatgacattccattagccaaaacaagtcctgtgacaggcacgatgtcagtcaccacagttaaattatcctgtcatagggagggatagtgaatattttgcagaagtaatatgatacaccataagggtacataatatccatgtctcccttcaaggagccatcctgttgtaggccataacggtaggcctattcatctgcacatttggtaatgtattcctggtgacaaagcagctactcttcaatcaaaagccgtgtaagaagcagttgaggaaaaaaagtcctggttgagctctgaaaaccttgcgttgataatttcattgaccaggatggcatcagtatcaaacttgaagaatgggtgtcagtgtctaagaaaaagattccagagacaatggtggtgtgctctttaacgaaatgcccatcaccactgctcttaatagcatgaagaccacatgctgtgagaaaacacaaacatcaattaccaagtcaagaaacagacactgaatgtgaaaaaggttttgaaataccttaagtaatttattttgtttctatttttccttctgtttgtgtacaagagtaatttaaaagaaaaagctatgtgaaaatagttggggttttttgtgtgttttgttttttgtggtggtgaaggaggaggcctaatgtccagaggactgtttatccctgaagtatgatatactaaaatatttcttattatttgtatcaattttccttggagctcaatgtgcccttgcagtcttcagactttattttaggaaaatatatttgcatgttttccccccattctcaatgtttggtgtcctggttcatcataccccacagaatgttatgtttatgtatcataccattcctctgtggacatgcatttactttgtttacaggttttggtttgggggttctctttttcctactctggacagtgcatgtacatttactttgcatgctggtgcttttttttctatagcaatagtgtctgatagacatatgcaagtcacatgtaatttaagatctagtagccacgctaaaaaacaagtaaaattaattttaatatatttaactcaatacattggagatattatttcagtaagatatttttcattcttatgaaactaagtctgtctggtttgcatatctcagttgagacactaaagttttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtattagtggctaccatattggtcagagcagattcataggatgatttcccaggtttgaagtgtgtgtatatttctggtattataagatgtcagactggtttttggagaaatatgttgtcttaatttttacctgctttgatatgacctttctgtgtgtacgtgtgacatttctttataaatgcaacatgttcacataggtcctacgttgattccttattaatgctgtgcatccttgaactgagaaagggggtgttattcctgagctatattataagaggatagtaaaggccaaggaccaggaaaatgagctggttaagcctcttgagcttgttacccccagaaacctcaccaataccctgtgaacgtcgtaagtggcccttctcccagtgaaacaacctaatggaggtttttggtgcatggtgatgtttttattcctctttagtagacatagaagctggaggctgcttgtcttccccagtttctccttcacccatgtacatatagtgggcaaagatggcatgcctatgtttttcagctgtttgagcccgctcactgttgacagattgttgctgttggtctgtgctccccaac

SEQ ID NO: 183671 - DNA, 2159 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371708
  CDS Start-End: 176-1546
agggggtcttactggactcctccactggcctgttctgtcagccctgccccctctccccctaagagcctgaggaggcctatggcagggccaagacagggcctcacactgttcctgcccccagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183672 - DNA, 2168 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371713
  CDS Start-End: 185-1555
ggagcctgaggaccctgcggggaccgggacccaagctgggcggggcggcctggctcccgggcctaaaacaggctgcggtcacgttgacctccgcaaggggcaggcgagtggacgggtgatccccatcgatctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183673 - DNA, 2275 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371724
  CDS Start-End: 292-1662
ggagcctgaggaccctgcggggaccgggacccaagctgggcggggcggcctggctcccgggcctaaaacaggctgcggtcacgttgacctccgcaaggggcaggcgagtggacgggtgatccccatcgatctggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183674 - DNA, 2258 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371731
  CDS Start-End: 275-1645
cagcgcgggagcagtgcttctgcggcaggcttctcagaatggggccccatgaagcctgagggactctctcctgataacaccctgtgccacctttttcattctggatccgcacccaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183675 - DNA, 2219 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371740
  CDS Start-End: 236-1606
gaatgtgccccggcgggagagggaagctgcagcgagagcgcgcggatctcagcgcgggagcagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183676 - DNA, 2112 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000371755
  CDS Start-End: 129-1499
gaatgtgccccggcgggagagggaagctgcagcgagagcgcgcggatctcagcgcgggagcagtgcttctgcggcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgttttttt

SEQ ID NO: 183677 - DNA, 2485 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000393841
  CDS Start-End: 492-1862
agtgcttctgcggcaggtgctgcccggggccggggactggggactggggactgccggggcggaagacgccgctgcccgcctgccacggagggcagggagggcgggcctgacggctccgcagcccggagaagggacgccgggtggggccccagtgcggagcgtgcggagccgcgcagcacgtggcgcgcacgggccagggagcctgaggaccctgcggggaccgggacccaagctgggcggggcggcctggctcccgggcctaaaacaggctgcggtcacgttgacctccgcaaggggcaggcgagtggacgggtgatccccatcgatctggagcccgtggacaaggcccactgcctgagcctgaactaggagcacctcctagggactgcccaggcttgctctgctctgacccttctgctggccagtctgggcacctgcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggct

SEQ ID NO: 183678 - DNA, 2326 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000393844
  CDS Start-End: 333-1703
gaagggcccctcccactgagtcggctctggtctccccgcccctgagccgcgaggactggacgcagctggctgcggagctctgggcgggcgctggggtcgcctgttgcagcctctcttccgcccggcggcccacaccggtcaggcccggcgcgggctgcgctctccagctgtggctatggccccagccccgagatgaggagggagagaactaggggcccgcaggcctgggaatttccgtcccccaccaagtccggatgctcactccaaagtctcagcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggct

SEQ ID NO: 183679 - DNA, 2171 bp, Homo sapiens
  Payload ID: 16187
  Gene Symbol: SLC29A1
  Gene Name: solute carrier family 29 (equilibrative nucleoside transporter), member 1
  Uniprot ID: Q99808
  ENST ID: ENST00000427851
  CDS Start-End: 179-1549
gggctgcgctctccagctgtggctatggccccagccccgagatgaggagggagagaactaggggcccgcaggcctgggaatttccgtcccccaccaagtccggatgctcactccaaagtctcagcaggcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtggcctgggaaggacagccgctggctgccaagcctggtgctggcccggctggtgtttgtgccactgctgctgctgtgcaacattaagccccgccgctacctgactgtggtcttcgagcacgatgcctggttcatcttcttcatggctgcctttgccttctccaacggctacctcgccagcctctgcatgtgcttcgggcccaagaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggc

SEQ ID NO: 183680 - DNA, 2262 bp, Homo sapiens
  Payload ID: 16188
  Gene Symbol: SLC29A2
  Gene Name: solute carrier family 29 (equilibrative nucleoside transporter), member 2
  ENST ID: ENST00000311161
  CDS Start-End: 111-1196
ggagcggctctggcatcacctcggagctgacgaagcgggaagagccccgcaccagtgctgcccctacagagctctcggcggggggtggaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgta

SEQ ID NO: 183681 - DNA, 2514 bp, Homo sapiens
  Payload ID: 16188
  Gene Symbol: SLC29A2
  Gene Name: solute carrier family 29 (equilibrative nucleoside transporter), member 2
  Uniprot ID: Q14542
  ENST ID: ENST00000357440
  CDS Start-End: 230-1600
ggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 183682 - DNA, 2505 bp, Homo sapiens
  Payload ID: 16188
  Gene Symbol: SLC29A2
  Gene Name: solute carrier family 29 (equilibrative nucleoside transporter), member 2
  Uniprot ID: Q14542
  ENST ID: ENST00000544554
  CDS Start-End: 221-1591
acgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 183683 - DNA, 2509 bp, Homo sapiens
  Payload ID: 16188
  Gene Symbol: SLC29A2
  Gene Name: solute carrier family 29 (equilibrative nucleoside transporter), member 2
  Uniprot ID: Q14542
  ENST ID: ENST00000546034
  CDS Start-End: 226-1596
gtggcagctctggttcccccgcccgggcccggctcgggttacgctctgggcggggactccgcagcggctccctagttagggggcgccccggtgggttccagctttaggggtcgcaggagcggctctggcatcacctcggagctgacgaagcgggaagagccccgcaccagtgctgcccctacagagctctcggcggggggtggaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttg

SEQ ID NO: 183684 - DNA, 2272 bp, Homo sapiens
  Payload ID: 16188
  Gene Symbol: SLC29A2
  Gene Name: solute carrier family 29 (equilibrative nucleoside transporter), member 2
  Uniprot ID: Q14542
  ENST ID: ENST00000541567
  CDS Start-End: 57-665
ggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttg

SEQ ID NO: 183685 - DNA, 2474 bp, Homo sapiens
  Payload ID: 16188
  Gene Symbol: SLC29A2
  Gene Name: solute carrier family 29 (equilibrative nucleoside transporter), member 2
  Uniprot ID: Q14542
  ENST ID: ENST00000540386
  CDS Start-End: 230-1135
ggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatgagaacgggattcccagtagtccccagaaagtagctctgaccctggatcttgacctggagaaggagccggaatcagagccagatgagccccagaagccaggaaaaccttcagtcttcactgtcttccagaagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 183686 - DNA, 2380 bp, Homo sapiens
  Payload ID: 16188
  Gene Symbol: SLC29A2
  Gene Name: solute carrier family 29 (equilibrative nucleoside transporter), member 2
  ENST ID: ENST00000619145
  CDS Start-End: 230-1315
ggtggcgcgaccctctgtccccgcctcggggcggagcccaggtcccagcctgcggagcgcgagacacgccgaaatccgcccgaggctacctgtgcgactccagccgccctgcaccggaatctggggagacccgccccccgccccaccggtctgcggccctccgccccagcgcaggtgcaggtgcggcttctctgcccctttcaccccaggcgcatccgccgcggcggccatggcgcgaggagacgccccgcgggacagctaccacctggtcgggatcagcttcttcatcctggggctgggcaccctccttccctggaacttcttcatcaccgccatcccgtacttccaggcgcgactggccggggccggcaacagcacagccaggatcctgagcaccaaccacacgggtcccgaggatgccttcaacttcaacaattgggtgacgctgctgtcccagctgcccctgctgctcttcaccctcctcaactccttcctgtaccagtgcgtcccggagacggtgcgcattctgggcagcctgctggccatactgctgctctttgccctgacagcagcgctggtcaaggtggacatgagccccggacccttcttctccatcaccatggcctccgtctgcttcatcaactccttcagtgcagtcctacagggcagcctcttcgggcagctgggcaccatgccctccacctacagcaccctcttcctcagcggccagggcctggctgggatctttgctgcccttgccatgctcctgtccatggccagtggcgtggacgccgagacctctgccctggggtactttatcacgccctgtgtgggcatcctcatgtccatcgtgtgttacctgagcctgcctcacctgaagtttgcccgctactacctggccaataaatcatcccaggcccaagctcaggagctggagaccaaagctgagctcctccagtctgatctggctgacagcgctgtgccttgtgttggtcttcacagtcaccctgtccgtcttccccgccatcacagccatggtgaccagctccaccagtcctgggaagtggagtcagttcttcaaccccatctgctgcttcctcctcttcaacatcatggactggctgggacggagcctgacctcttacttcctgtggccagacgaggacagccggctgctgcccctgctggtctgcctgcggttcctgttcgtgcccctcttcatgctgtgccacgtgccccagaggtcccggctgcccatcctcttcccacaggatgcctacttcatcaccttcatgctgctctttgccgtttctaatggctacctggtgtccctcaccatgtgcctggcgcccaggcaggtgctgccacacgagagggaggtggccggcgccctcatgaccttcttcctggccctgggactttcctgtggagcctccctctccttcctcttcaaggcgctgctctgaagtggcccctccaggctctttggcagcctcttctcgacgtctccttccggagctgagatccagcccagggcgaatggcgagcttggctcaggcctctgcggggtggaggcccctgggcctgaggctgccagcagcgggcaggagctgctcttcatccacttggagtgctgtggggaagaaatcaccaccggtcattctaaccctcacccaggaatgggggtgactcgcacaagacctcatggaaagggtgatgactagggaaaagagggtgcagggcacggctgctccccaccaccaggtctgcatttgttcatcatcatcaggagcagaggtgaccagagggttcagagtgggaggcggggccagcccaggccaggagcgcctcatcttcccaggcctcagccacccagggtaaaaggtgccagggaagttgtgggcacctgagaggaggaacagatgtggaggacctgagggtgctcaaagggccaggctcagcctcaagcagtgttttcattgccaacacttactgtacccactccgcagagcccagctgggcctgggccccagggccacagctagcctgcatgtgtgtactgcactttacagtttgcaaagctcttccatacccactctctcaccgaagcctaattgaggctcttggaaggagtcaggcaaggattgtgcttcccccattatacaggtgacaaaactgagtcctggggaaagtgactggtccgtggtagagccgggacccaatcccctctctctcctccctgttggtgctgttcttcctgcccaacacctgtttctcttttcctcaaggggtttggggcaggagcctgggcacttactccccgtttttgctgtttctccttctgaccctgctcttgggtctaataaccccatttatttgt

SEQ ID NO: 183687 - DNA, 2257 bp, Homo sapiens
  Payload ID: 16189
  Gene Symbol: SLC29A3
  Gene Name: solute carrier family 29 (equilibrative nucleoside transporter), member 3
  Uniprot ID: Q9BZD2
  ENST ID: ENST00000373189
  CDS Start-End: 53-1480
cagtggtcctggccgtgcgccggaggcagcggcggcgtggcgcagcggcgacatggccgttgtctcagaggacgactttcagcacagttcaaactccacctacagaaccacaagcagcagtctccgagctgaccaggaggcactgcttgagaagctgctggaccgcccgccccctggcctgcagaggcccgaggaccgcttctgtggcacatacatcatcttcttcagcctgggcattggcagtctactgccatggaacttctttatcactgccaaggagtactggatgttcaaactccgcaactcctccagcccagccaccggggaggaccctgagggctcagacatcctgaactactttgagagctaccttgccgttgcctccaccgtgccctccatgctgtgcctggtggccaacttcctgcttgtcaacagggttgcagtccacatccgtgtcctggcctcactgacggtcatcctggccatcttcatggtgataactgcactggtgaaggtggacacttcctcctggacccgtggcttttttgcggtcaccattgtctgcatggtgatcctcagcggtgcctccactgtcttcagcagcagcatctacggcatgaccggctcctttcctatgaggaactcccaggcactgatatcaggaggagccatgggcgggacggtcagcgccgtggcctcattggtggacttggctgcatccagtgatgtgaggaacagcgccctggccttcttcctgacggccactgtcttcctcgtgctctgcatgggactctacctgctgctgtccaggctggagtatgccaggtactacatgaggcctgttcttgcggcccatgtgttttctggtgaagaggagcttccccaggactccctcagtgccccttcggtggcctccagattcattgattcccacacaccccctctccgccccatcctgaagaagacggccagcctgggcttctgtgtcacctacgtcttcttcatcaccagcctcatctaccccgccatctgcaccaacatcgagtccctcaacaagggttcgggctcactgtggaccaccaagtttttcatccccctcactaccttcctcctgtacaactttgctgacctatgtggccggcagctcaccgcctggatccaggtgccagggcccaatagcaaggcgctcccagggttcgtgctcctccggacctgcctcatccccctcttcgtgctctgtaactaccagccccgcgtccacctgaagactgtggtcttccagtccgatgtgtaccccgcactcctcagctccctgctggggctcagcaacggctacctcagcaccctggccctcctctacgggcctaagattgtgcccagggagctggctgaggccacgggagtggtgatgtccttttatgtgtgcttgggcttaacactgggctcagcctgctctaccctcctggtgcacctcatctagaagggaggacacaaggacattggtgcttcagagcctttgaagatgagaagagagtgcaggagggctgggggccatggaggaaaggcctaaagtttcacttggggacagagagcagagcacactcgggcctcatccctcccaagatgccagtgagccacgtccatgcccattccgtgcaaggcagatattccagtcatattaacagaacactcctgagacagttgaagaagaaatagcacaaatcaggggtactcccttcacagctgatggttaacattccaccttctttctagcccttcaaagatgctgccagtgttcgccctagagttattacaaagccagtgccaaaacccagccatgggctctttgcaacctcccagctgcgctcattccagctgacagcgagatgcaagcaaatgctcagctctccttaccctgaaggggtctccctggaatggaagtcccctggcatggtcagtcctcaggcccaagactcaagtgtgcacagacccctgtgttctgtgggtgaacaactgcccactaaccagactggaaaacccagaaagatgggccttccatgaatgcttcattccagagggaccagagggcctccctgtgcaagggatcaagcatgtctggcctgggttttcaaaaaaagagggatcctcatgacctggtggtctatggcctgggtcaagatgagggtctttcagtgttcctgtttacaacatgtcaaagccattggttcaagggcgtaataaatacttgcgtattcaa

SEQ ID NO: 183688 - DNA, 2839 bp, Homo sapiens
  Payload ID: 16190
  Gene Symbol: SLC29A4
  Gene Name: solute carrier family 29 (equilibrative nucleoside transporter), member 4
  Uniprot ID: Q7RTT9
  ENST ID: ENST00000297195
  CDS Start-End: 126-1718
ggggccgggcggactcggggaccggcggaggacgccgggcgcgcccggcccgaggctgggggagcggggcggcgtggcgggcgcgccgaggaccccaggccgggccgggccgagcagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgca

SEQ ID NO: 183689 - DNA, 5685 bp, Homo sapiens
  Payload ID: 16190
  Gene Symbol: SLC29A4
  Gene Name: solute carrier family 29 (equilibrative nucleoside transporter), member 4
  Uniprot ID: Q7RTT9
  ENST ID: ENST00000396872
  CDS Start-End: 162-1754
tggtggcctgggctgtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgccgcctgcaagcagagtttgtgcgtggacgggggctgggactgccatctcgggataccggtggaactcgggctgccccgcataagccggtcctcagtcttcccatctgtgaggtgggccgggtggatcagggagcaggagggtgtcctcacactgggtaggcttggtttgtgggcagcgctgggtagtggggtgagagctgggagcacttagggtttgtcgctcaccttgaccgcccgccccccccaccccttcgtgaggatcagggaggatggccacatgcagcccatttgaaggggaaacaaagtgggcggggcttggcccctgcccctcagggactgcactgcatcctaggagtcagagcctcctggcttcgagcctcatcccttttgctgatttgtgcaatttggacaaaatcctgcactgttctgtgcctcatttctttctttttttattttttttttgagactgagtcttgctcttgtcacccaggctggagtgcagtggcacgatcttggctcactgcaatctctgccttccaggttcaagcgattctcctgcctcagcctctcaagtagctgggattacaggtacgcaccaccacacctggctaatttgtcttgtggagaccgggtttcaccatgttggccatgctggtctcgaactcctgatctcaagtgatccatctgtctcatcctcccaaagtgttgggattacaggtgtgagccactgcacccgtcctgtgcctcatttttgttttttctttctttacaagacaggctctcgctctgtcactgaggctggagtgcagtggtgccatcatagctcactgcagcctccacctcctgggctccagtgatcctcccacctcagcctcccaaatagctgtgaatacaggcgcgtgccaccacgtctggccagattcttttattttgtgtagagatggggtcttgctgttgcccagactggtctcaaagtctgggcctcaagtgttccccctgccttggcctcccaaagtgccaggattacaggtatgagtcactgcgcctggcctgttctgtccttagcttccccaaggaatggggctggtccaggttttgatgtgggtcccgtaaaggagggcacgagggccacctatgctctggcaggcatcctccctggggcccaggtgggcggccacttgggccaagactgcgccaggtgacaccagagtgtttcccagagcccatgccgggcccttcccttgcccgaggccggctggctgccctccatgggttaccctctttgcaaagccccgaatgtcctctgcaggccacccacactaaccaggtcagtcactgggcagccagacccccacctatagcttccctaggccccagtgcagagatgccgtccacccccatctaggtgagggcttggggccactcttagcattagtatcattttcttctagtatcattttgtggtaggcatggctggaaatgtgcagctttgctttttttttttttttttttggaggagtttcgcttttgttgcccaggctggagtgcaatggctcgatttcagctcactgcaacctctgcctgccgggttcaagcgattctcctgcctcagcctcccgagtagctgggattacaggcatgtgccaccatgcccggctaattttgtgcttttagtagagacgaggtttctccatgttggtcaggctggtcttgaactcccgacctcaggtgatccacctgcctcagcctcccaaagtgctgggattacaggcatgagccaccatgcctggcactggttttttgagatggaatctcgttatgtcaccccagctggagggcagtggcacgatctcagctcactgtaacctttgccgtgggttcaagcgattctcctgcctcagcctcccaagtagctgggattacaggcacgctccaccacacccggctaatttttttgtatttttagtagagatggggtttcaccatattggccaggctggtcttgaactcctgacctcaagtgatccgcctcccttggcctcccaaagtgctgggattacaggcgtgagccaccgtgcccatccaacttaacttttaattttttctcatgtaaatttgttcaatttctttttttttttttttttttttttttgagacaatctctgtcacccccaggccagagtgcagtggtgcgatctcaactcactgcaacctccacccgccgggtccctgtgattttcccacctcagcctcccgagtagctgggattacaggtgtgggccaccacacccggctaatttttgtatttttagtagagacggggtttcaccacattgctcaggctggtctgaaactcctggcctgaagtgatcctcccgcctcggcctcctaaagtgctgggattacaggcacgctctaccacacctggctaatttttttttgtatttttagtagagatggggtttcaccatattggccaggctggtctcgaactcctgacttcaagtgatccgcctgccttggcctcccaaagtgctggcattacaggcgtgagccactgtgcccagccgatgagctcatttagatggctgcatggggtcaccgcccctgcacgcgtggcacccaacttcttccagtcgaatcctgcttcttggtgccctgatatggcagaatgcccccagacaccacccctactccagcccctgaaataaaccactccagacaattttatttttccaattaaatcttttctttttttttatgaaaaaagatcacacagaatttgccaacaaacaaaattccaaaa

SEQ ID NO: 183690 - DNA, 2734 bp, Homo sapiens
  Payload ID: 16190
  Gene Symbol: SLC29A4
  Gene Name: solute carrier family 29 (equilibrative nucleoside transporter), member 4
  Uniprot ID: Q7RTT9
  ENST ID: ENST00000406453
  CDS Start-End: 63-1613
ggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcagcatctgcgacgtgtggctgcagctcttctctcgggaccaggcctacgccatcaacctggccgctgtgggcaccgtggccttcggctgcacagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgca

SEQ ID NO: 183691 - DNA, 623 bp, Homo sapiens
  Payload ID: 16190
  Gene Symbol: SLC29A4
  Gene Name: solute carrier family 29 (equilibrative nucleoside transporter), member 4
  ENST ID: ENST00000434816
  CDS Start-End: 135-623
acagcctcctcttgtaaatagagagtacaaaggcttctccgagtagtgtgtatgccgggcagacgctgatgccacggggagaggccttagaaggagcacaggaaagtcccaggtaagaaccagcagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggac

SEQ ID NO: 183692 - DNA, 585 bp, Homo sapiens
  Payload ID: 16190
  Gene Symbol: SLC29A4
  Gene Name: solute carrier family 29 (equilibrative nucleoside transporter), member 4
  ENST ID: ENST00000444741
  CDS Start-End: 133-585
gtggaccggggccgggcggactcggggaccggcggaggacgccgggcgcgcccggcccgaggctgggggagcggggcggcgtggcgggcgcgccgaggaccccaggccgggccgggccgagcagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcagcatctgcgacgtgtggctgcagctcttctctcgggacc

SEQ ID NO: 183693 - DNA, 2989 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000260649
  CDS Start-End: 77-2134
gaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaa

SEQ ID NO: 183694 - DNA, 2909 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000409229
  CDS Start-End: 1-1695
atggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagcca

SEQ ID NO: 183695 - DNA, 1418 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000409740
  CDS Start-End: 309-1259
cacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttg

SEQ ID NO: 183696 - DNA, 2424 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000409380
  CDS Start-End: 1019-2242
tcttcagttccttttgtattctggatactgattttttattgtttatgtacactaaaaatctcttgccctggttgtgtccaggtgggctgtgtgttgaattggaaagggtgcatgtccttgaaaggcagcagctactactcagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacgttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagt

SEQ ID NO: 183697 - DNA, 792 bp, Homo sapiens
  Payload ID: 16191
  Gene Symbol: SLC3A1
  Gene Name: solute carrier family 3 (amino acid transporter heavy chain), member 1
  ENST ID: ENST00000409294
  CDS Start-End: 69-623
taaattcctcctagaagcaaagcacctgagagatgagatccaagtaaataagacccaaatcccggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacc

SEQ ID NO: 183698 - DNA, 1537 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000409741
  CDS Start-End: 1-1509
atggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctat

SEQ ID NO: 183699 - DNA, 2334 bp, Homo sapiens
  Payload ID: 16191
  Gene Symbol: SLC3A1
  Gene Name: solute carrier family 3 (amino acid transporter heavy chain), member 1
  ENST ID: ENST00000409387
  CDS Start-End: 73-1767
aagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgattcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaa

SEQ ID NO: 183700 - DNA, 1426 bp, Homo sapiens
  Payload ID: 16191
  Gene Symbol: SLC3A1
  Gene Name: solute carrier family 3 (amino acid transporter heavy chain), member 1
  Uniprot ID: Q07837
  ENST ID: ENST00000410056
  CDS Start-End: 1-1176
atggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgtta

SEQ ID NO: 183701 - DNA, 574 bp, Homo sapiens
  Payload ID: 16191
  Gene Symbol: SLC3A1
  Gene Name: solute carrier family 3 (amino acid transporter heavy chain), member 1
  ENST ID: ENST00000427285
  CDS Start-End: 146-574
agcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattattaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccgg

SEQ ID NO: 183702 - DNA, 1737 bp, Homo sapiens
  Payload ID: 16191
  Gene Symbol: SLC3A1
  Gene Name: solute carrier family 3 (amino acid transporter heavy chain), member 1
  ENST ID: ENST00000611973
  CDS Start-End: 79-1737
aagaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaatcttgctccgtcacccatgctcgagtgcagtggcgtga

SEQ ID NO: 183703 - DNA, 1904 bp, Homo sapiens
  Payload ID: 16192
  Gene Symbol: SLC3A2
  Gene Name: solute carrier family 3 (amino acid transporter heavy chain), member 2
  Uniprot ID: P08195
  ENST ID: ENST00000338663
  CDS Start-End: 153-1742
cagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatg

SEQ ID NO: 183704 - DNA, 1993 bp, Homo sapiens
  Payload ID: 16192
  Gene Symbol: SLC3A2
  Gene Name: solute carrier family 3 (amino acid transporter heavy chain), member 2
  Uniprot ID: P08195
  ENST ID: ENST00000377889
  CDS Start-End: 127-1833
gcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgca

SEQ ID NO: 183705 - DNA, 2161 bp, Homo sapiens
  Payload ID: 16192
  Gene Symbol: SLC3A2
  Gene Name: solute carrier family 3 (amino acid transporter heavy chain), member 2
  Uniprot ID: P08195
  ENST ID: ENST00000377890
  CDS Start-End: 169-2061
accgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgca

SEQ ID NO: 183706 - DNA, 2222 bp, Homo sapiens
  Payload ID: 16192
  Gene Symbol: SLC3A2
  Gene Name: solute carrier family 3 (amino acid transporter heavy chain), member 2
  ENST ID: ENST00000377891
  CDS Start-End: 160-2055
attgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 183707 - DNA, 565 bp, Homo sapiens
  Payload ID: 16192
  Gene Symbol: SLC3A2
  Gene Name: solute carrier family 3 (amino acid transporter heavy chain), member 2
  ENST ID: ENST00000539458
  CDS Start-End: 129-565
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttga

SEQ ID NO: 183708 - DNA, 1300 bp, Homo sapiens
  Payload ID: 16192
  Gene Symbol: SLC3A2
  Gene Name: solute carrier family 3 (amino acid transporter heavy chain), member 2
  ENST ID: ENST00000539891
  CDS Start-End: 1098-1300
agttgcaaccggtttctgaagtaatgtgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagatagagacaattttcaacatgttgaccggtctggttttgaactcgcctggcctgccttcccatatcttaaggcccttccttgctcacatctgtttcaatggaatgaattttgcccgggttcaaattcaagcttttgtaccaagcatccgtgtcattctggaccttactcccaactaccggggtgagaactcgtggttctccactcaggttgacactgtggccaccaaggtgaaggcctcaggaaactgggagaggggggatcttgactgacattttagatcctgtctgctgctcactgattatgactgtggacgcgtctccctgcttctctgggtctgtttcttcatctctaaaataggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgtt

SEQ ID NO: 183709 - DNA, 741 bp, Homo sapiens
  Payload ID: 16192
  Gene Symbol: SLC3A2
  Gene Name: solute carrier family 3 (amino acid transporter heavy chain), member 2
  ENST ID: ENST00000538084
  CDS Start-End: 1-741
cttcccagaatgccgagatgatagagacggggtctgactgtgttacccaggctggtcttcaactcttggcctcaagtgatcctcctgccttagcttccaagaatgctgaggttacagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgact

SEQ ID NO: 183710 - DNA, 534 bp, Homo sapiens
  Payload ID: 16192
  Gene Symbol: SLC3A2
  Gene Name: solute carrier family 3 (amino acid transporter heavy chain), member 2
  ENST ID: ENST00000539507
  CDS Start-End: 1-367
gctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaa

SEQ ID NO: 183711 - DNA, 589 bp, Homo sapiens
  Payload ID: 16192
  Gene Symbol: SLC3A2
  Gene Name: solute carrier family 3 (amino acid transporter heavy chain), member 2
  ENST ID: ENST00000544377
  CDS Start-End: 185-589
gcaagccttggtgggggaaaaggcagaagttgtgactggctgcctctgagagtgcaagtagccatgcaaagttgggaaaaccagacggcggccggagccgtgaaccaggggcaaatggaggatggtgttggggtagtcactagcctgccggaatggaagaagaggggcgtttgggggcggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccac

SEQ ID NO: 183712 - DNA, 2084 bp, Homo sapiens
  Payload ID: 16192
  Gene Symbol: SLC3A2
  Gene Name: solute carrier family 3 (amino acid transporter heavy chain), member 2
  ENST ID: ENST00000535296
  CDS Start-End: 103-1902
cacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgctt

SEQ ID NO: 183713 - DNA, 269 bp, Homo sapiens
  Payload ID: 16192
  Gene Symbol: SLC3A2
  Gene Name: solute carrier family 3 (amino acid transporter heavy chain), member 2
  ENST ID: ENST00000541372
  CDS Start-End: 129-269
agatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggcggcagccgcggctaagttcacgggcctgtccaaggaggagctgctgaaggtggcaggcagccccggctgggtacgcacccgctgggcactgctgctgctcttctgg

SEQ ID NO: 183714 - DNA, 1486 bp, Homo sapiens
  Payload ID: 16192
  Gene Symbol: SLC3A2
  Gene Name: solute carrier family 3 (amino acid transporter heavy chain), member 2
  ENST ID: ENST00000536981
  CDS Start-End: 807-1334
tgcaggactccttacatcagctcctctgagtctcgtgattcagccttgcctccctctctccccctttgccccctccccgtcccacccttaggcgctgggagaagggagggtggggaggtcaggggcctctcagaggggcctcacttgttaacccagcccccatttcaggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtca

SEQ ID NO: 183715 - DNA, 595 bp, Homo sapiens
  Payload ID: 16192
  Gene Symbol: SLC3A2
  Gene Name: solute carrier family 3 (amino acid transporter heavy chain), member 2
  ENST ID: ENST00000541425
  CDS Start-End: 1-75
ttctccactcaggttgacactgtggccaccaaggtgaaggcctcaggaaactgggagaggggggatcttgactgacattttagatcctgtctgctgctcactgattatgactgtggacgcgtctccctgcttctctgggtctgtttcttcatctctaaaataggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggat

SEQ ID NO: 183716 - DNA, 5474 bp, Homo sapiens
  Payload ID: 16193
  Gene Symbol: SLC30A1
  Gene Name: solute carrier family 30 (zinc transporter), member 1
  Uniprot ID: Q9Y6M5
  ENST ID: ENST00000367001
  CDS Start-End: 131-1654
cctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgccatcctgctggaggccatcgagcgcttcatcgagccgcacgagatgcagcagccgctggtggtccttggggtcggcgtggccgggctgctggtcaacgtgctggggctctgcctcttccaccatcacagcggcttcagccaggactccggccacggccactcgcacgggggtcacggccacggccacggcctccccaaggggcctcgcgttaagagcacccgccccgggagcagcgacatcaacgtggccccgggcgagcagggtcccgaccaggaggagaccaacaccctggtggccaataccagcaactccaacgggctgaaattggaccccgcagacccagaaaaccccagaagtggtgatacagtggaagtacaagtgaatggaaatcttgtcagagaacctgaccatatggaactggaagaagatagggctggacaacttaacatgcgtggagtttttctgcatgtccttggagatgccttgggttcagtgattgtagtagtaaatgccttagtcttttacttttcttggaaaggttgttctgaaggggatttttgtgtgaatccatgtttccctgacccctgcaaagcatttgtagaaataattaatagtactcatgcatcagtttatgaggctggtccttgctgggtgctatatttagatccaactctttgtgttgtaatggtttgtatacttctttacacaacctatccattacttaaggaatctgctcttattcttctacaaactgttcctaaacaaattgatatcagaaatttgataaaagaacttcgaaatgttgaaggagttgaggaagttcatgaattacatgtttggcaacttgctggaagcagaatcattgccactgctcacataaaatgtgaagatccaacatcatacatggaggtggctaaaaccattaaagacgtttttcataatcacggaattcacgctactaccattcagcctgaatttgctagtgtaggctctaaatcaagtgtagttccgtgtgaacttgcctgcagaacccagtgtgctttgaagcaatgttgtgggacactaccacaagccccttctggaaaggatgcagaaaagaccccagcagttagcatttcttgtttagaacttagtaacaatctagagaagaagcccaggaggactaaagctgaaaacatccctgctgttgtgatagagattaaaaacatgccaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtacagctatgctgtgactgttttggaaagccagttttaacactatgttacatttttgtttaaagtaagttaaaccttatataacataatgacatttgatttctggatttttcccatgataaaaattagggggataaataaaattgttactggaatttctctgcttttcttttcccccagtgttatactttattagaattataattgatagaactttaaaatcatcaacagtttgtttcctttgacattttaggtgatattgccctttgagatcattacatagcataatggcagcatattttaagagtgactcatggctattagtaggaaataagatcagttactatcctgtattctgtattgctggctattaaacagtaagataattaacaaattgaactacagtttacacacaatggggcaaatggggtagtaagagcaaggaagaaagtttaccaaactaaatatttaggttattgtatgataatattgagactacatttctaaattattttgagaatttcaactttttattctaccaaagttaatctgaaacttggacatgttcaccagcattactttctttgaaagattggtataaaaacattgagctgcaagtttatttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgagcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatcta

SEQ ID NO: 183717 - DNA, 2494 bp, Homo sapiens
  Payload ID: 16194
  Gene Symbol: SLC30A2
  Gene Name: solute carrier family 30 (zinc transporter), member 2
  Uniprot ID: Q9BRI3
  ENST ID: ENST00000374276
  CDS Start-End: 238-1356
cggggcgcagcggctgacccgagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttggtgggtacctggcacacagcttggctgtcatgactgacgcagcacacctgctcactgactttgccagcatgctcatcagcctcttctccctctggatgtcctcccggccagccaccaagaccatgaactttggctggcagagagctgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagta

SEQ ID NO: 183718 - DNA, 3097 bp, Homo sapiens
  Payload ID: 16194
  Gene Symbol: SLC30A2
  Gene Name: solute carrier family 30 (zinc transporter), member 2
  Uniprot ID: Q9BRI3
  ENST ID: ENST00000374278
  CDS Start-End: 218-1189
gagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtacctgtggttgttgaagattggttacttttaccatcctggggacagggaactctgtggcccgaggctgcctcactgaggagtcaggtgggcttcccagcctccccaggggcagtgctgagtttgtcttgactgttctggcccaaggtgggaggaggtgggtttggtcacttgcctcccactttaaatctctgtctttccatctgtgaaatgacctctttgtgccttcccagcactgtcatcctgatcgcctgtgttctaggtaggtgggtccttcagcccctccaggtctgtgaaaagtctgtggaaagcactggcctggagaggggtggggggttgctggtgggtgctccattccaccacaatctcaggggactcaacctcccctacccaactccccacccccacccaagccatggcaggccccaggaacttgatcctgggctttgccgtatgccaagtccttacacccctctcaagagacagtcattggctgggcacggtggctcatgcctgcaatcccagcaccttgggaggctgaggcaggcagatgacttgaggccaggagttcgagaccagcctggccaatatggcgaaacctcatttctactaaaaatacaaaaactagccaggcgtggtggcttgtgcctgtaatcccagctactcgggaggctgaggcaggagaatcgcttgaaccggggaggcagaggttgcagtgagctgagatcacaccactgcactccagcctgggtgacagagcgagactccagctt

SEQ ID NO: 183719 - DNA, 2260 bp, Homo sapiens
  Payload ID: 16195
  Gene Symbol: SLC30A3
  Gene Name: solute carrier family 30 (zinc transporter), member 3
  Uniprot ID: Q99726
  ENST ID: ENST00000233535
  CDS Start-End: 354-1520
gggacggggctgtggagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgca

SEQ ID NO: 183720 - DNA, 904 bp, Homo sapiens
  Payload ID: 16195
  Gene Symbol: SLC30A3
  Gene Name: solute carrier family 30 (zinc transporter), member 3
  ENST ID: ENST00000445870
  CDS Start-End: 1-904
cactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagct

SEQ ID NO: 183721 - DNA, 590 bp, Homo sapiens
  Payload ID: 16195
  Gene Symbol: SLC30A3
  Gene Name: solute carrier family 30 (zinc transporter), member 3
  ENST ID: ENST00000426569
  CDS Start-End: 295-590
gagggcttagcaggcctgcggcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggc

SEQ ID NO: 183722 - DNA, 997 bp, Homo sapiens
  Payload ID: 16195
  Gene Symbol: SLC30A3
  Gene Name: solute carrier family 30 (zinc transporter), member 3
  ENST ID: ENST00000426924
  CDS Start-End: 308-997
ctgctctcaaaccaccccacttctgtccctcagaggtgggacagtggggagaggaggaagaggactcagaggctggagaaggaagagaaaaggcgttgctgtgggaaagacctggcaaggaaaaggcagcggaaccccagagagcagggtagacgcctgcggcccaggagaaccgagcaaggcaaggagctcaaagggagagctctgagtgtgcagggcacctctggccctgtgccgactcctcacctgggtctggccctttacctgggagtcgttctcttaagccaggagggcaccacccatcttgatggcccaactcactccaggaaacacaatgggtttgctgaccgtggcggatgagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctc

SEQ ID NO: 183723 - DNA, 540 bp, Homo sapiens
  Payload ID: 16195
  Gene Symbol: SLC30A3
  Gene Name: solute carrier family 30 (zinc transporter), member 3
  ENST ID: ENST00000450118
  CDS Start-End: 209-540
acagcgggccgggggtggcaggagaaccgccaacgcgccccgccggcccccgcgcctgccgccaccgtccacctgcccctctgagcggccgtccgacctccctgcccacccccgtgggccatcttgtctgtcggctgaccgtccgtttgtctccggaatttggcaggagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcct

SEQ ID NO: 183724 - DNA, 834 bp, Homo sapiens
  Payload ID: 16195
  Gene Symbol: SLC30A3
  Gene Name: solute carrier family 30 (zinc transporter), member 3
  ENST ID: ENST00000424577
  CDS Start-End: 324-834
gcttagcaggcctgcggcccaaggcagcgtaggagcgttgctgccaggccttggggcagggattcccaccgagcccctcttccccagcaggagggcaccacccatcttgatggcccaactcactccaggaaacacaatgggtttgctgaccgtggcggatgagagtggcggcaggtgcgaggggagagaacattgagcatttgaagcttcgacttgaggctcggccaccgactttgctgtaatgggtccgctcctgtttctgcctccgcgtgagggttgcggccacagggtgacggcgtggtgggcgacacccccgcgcaggcatgcacagagtggtggtcgttgggcgaagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgt

SEQ ID NO: 183725 - DNA, 899 bp, Homo sapiens
  Payload ID: 16195
  Gene Symbol: SLC30A3
  Gene Name: solute carrier family 30 (zinc transporter), member 3
  ENST ID: ENST00000432351
  CDS Start-End: 180-899
gactgtcacagcttcgagtgcacaatcctcttcccaccccctcccattctacagtggcggcaggtgcgaggggagagaacattgagcatttgaagcttcgacttgaggctcggccaccgactttgcttctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttctt

SEQ ID NO: 183726 - DNA, 7157 bp, Homo sapiens
  Payload ID: 16196
  Gene Symbol: SLC30A4
  Gene Name: solute carrier family 30 (zinc transporter), member 4
  Uniprot ID: O14863
  ENST ID: ENST00000261867
  CDS Start-End: 316-1605
cgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaataatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatttggtacagagtgttggtgtgctaatagctgcatacatcatacgattcaagccagaatacaagattgctgaccccatctgtacatacgtattttcattacttgtggcttttacaacatttcgaatcatatgggatacagtagttataatactagaaggtgtgccaagccatttgaatgtagactatatcaaagaagccttgatgaaaatagaagatgtatattcagtcgaagatttaaatatctggtctctcacttcaggaaaatctactgccatagttcacatacagctaattcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattttgggaactcctgccttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaatattattctgaatggctgaagttagtcttaaactcaaattactatatgatgatttaaaacaaaataaaagagcgaggatgggggttggagtttcaggtttatgtcttcccgacatcacttttatcattcatgaaattgtcttaaaaaagcaagagactgcaaaatgtaaacagtaatcttctgtccctttaagaactgccaacaatttgtacaaaaaatgtggtacgttggttcctgcctccactccaggtcatctgtgtgtttagcctttcagggtaaactctagagggttcagtttataattcccacctttcacatatagttcaacaacattaatccagagagaattttatgttttatgatatgggttatgttttattatatattttatgttttatgatatgggttagggattctccatggactccagaaaccctaaaatacaattttgaggttttccaataataccatagcagaaatgtccaaggggttgggggaagatattactttgagaaaacagaaatgtaaaggatttttgaccttatatatgtgtgtggttttgtttttgtttttgttcttgagagagtctcactctgtcacccaggctggagtgcagtggcgtgacctctgctcactgtaacctctgcctcctgggttcaagtgattcttctgcctcagcctcccaactagctgggactacaggtacaccacacccagctcatttttttgtatttttagtagagacagggttttgccacattggcctgtctggtcttgaactcctgacctcaggtgatccgcctgccttggccttccagagtgctgggattacagcatgagccaccatgcctggcctgtatgtgtgtgttttaaagcactagatagggatggacattaaatctgtgttgcagggaaactaaacagaggtttccaaactgaaggcaacctaattgtaaatgcctgtgttaaagaggcagcttgactgttcatgtttcattttgcaaccattggttttgagattatcttttatgcacatttggagtcccttttcaacagtgacagtttcttacacgaagaatggatatggttattgggctcctctaagaatcagagtagggtaacaatgtaccaggcaaattgtaagttgaaattctagataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaagagttcatgaccagcctggtcttttgtagagaccctgtctctacaaaaatataaaaatcagccaggcgtcgtgcacacctgtagtatcagctacttgtaaggctgtggcagaagtgctttagcccaggaggttgaggctgcagtgagccatgtccacaccattgcactgcagcctgagtaacaaaatgagaccctatctcaaaaacaaaaaggaaaagaaaatatacatgatgggattcctattgtgaagtcatttaaaataatgacttgaatttctcagaaatttcaggagcatataaactatttaaatcaaaatattcttacatatagaaaccaagtaagaataaatgagagatatttcagtggacatctggacatatttatggactttgagtatctagcaagtagaaaggaaaaaaatattcatcatactctaatcatttttttatatctattgagcttgtttcttgtaaacttttctttatcttataaaggcatatctcgcttttgtatcgacctgttccttaaaaaatgtatttgataaaacaggctaaaattcatttgagtattgaaaagaattctttttttttttttaagatggtgtctcactgtcacccaggctggagtgcagtggcacagttgggctcactgcagcctctgcctcccaggctcaagtggtcctcccatctcagcctcccaagtagctggtaccacaggcatgcaccaccacacccagctaattttttgtatttttggtagacacagtgtttcaccatgttgcccaggctggtcttgaactcctgagctcaagtgatctgcccacctcggcctcccaaagtgctgggcttatgggcatgaaccactgtgcccagccaaaaagaatccttttgtaaaatacagaaacactgcaaacctttgtaaatcttttttttttttttttttttttttttttaatgagatggggtctccctatgttgcccaggctggtcttgagctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcatctttcagagacaaggcaccgcttagaaatgtatgtccaggtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcagtattgaattacatgtgtgcactcaggcctgccagtcactgaattctgacttgtaaagggtttaacctgctgttccaatcattgaggaccaatttgctttttgataagattggaaaacatttatggagactttcccagttaaatctatgacagtgtccacttaaatagtgcaatttagtatattctcagataactgcaacacaaaattgaaatgtgccagtatgtcatctttctacctggaagatactgtatatttggaaagtttatgcttctctcaataaatacatgttattaaataagccatatcacagtttaagaaattgtatatactttatcatatgccctttcagaaaccaggtattttgcatatgattgattttagaaagattttgaagctggggtttgtccatgttaattaagatcaaagtatatatatatatatatatatgtgctgtatttgcaactttcacattgtaatttcctatacacttattaaagtattgttttgccatgtggtttattaaataaaaatgtacagtctcttaaatatctgctctttttattaagtaatattagtaggcctaaaaacattgttcttaaaagaaaatcttttataattataatgtcattttataatgccctcttatatgtttaagaaataaaactgaaaaaaatctt

SEQ ID NO: 183727 - DNA, 1317 bp, Homo sapiens
  Payload ID: 16197
  Gene Symbol: SLC30A5
  Gene Name: solute carrier family 30 (zinc transporter), member 5
  Uniprot ID: Q8TAD4
  ENST ID: ENST00000380860
  CDS Start-End: 266-622
gcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaa

SEQ ID NO: 183728 - DNA, 4360 bp, Homo sapiens
  Payload ID: 16197
  Gene Symbol: SLC30A5
  Gene Name: solute carrier family 30 (zinc transporter), member 5
  Uniprot ID: Q8TAD4
  ENST ID: ENST00000396591
  CDS Start-End: 611-2908
gcactccagcctgggcaacaggagcgaaactccatctcaaaacaaaaaaaaaaagaatccctaacgcagaggaaaagattggtgagctttgtttaatcacacacgctgtacattttccacgccctccccctctgccctacaggaatccgctgtacttctgacggcccataggtggcactgtagggacaggtaagtgcacagggagcgccacccggagaggctgataggaggcggagcttcaatgcgacacaacgtggcgggaggagcctaagggacgaggaaaggcgagtgttctgcttgcgcagacgcaaggctgggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccagtctcagttggagggctgatagtaaaccttattggtatctgtgcctttagccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtgggaaaa

SEQ ID NO: 183729 - DNA, 681 bp, Homo sapiens
  Payload ID: 16197
  Gene Symbol: SLC30A5
  Gene Name: solute carrier family 30 (zinc transporter), member 5
  Uniprot ID: Q8TAD4
  ENST ID: ENST00000502979
  CDS Start-End: 59-292
ggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagca

SEQ ID NO: 183730 - DNA, 763 bp, Homo sapiens
  Payload ID: 16197
  Gene Symbol: SLC30A5
  Gene Name: solute carrier family 30 (zinc transporter), member 5
  ENST ID: ENST00000511158
  CDS Start-End: 1-254
cactgattaaagatgcctgccaggttctactcctgagattgccaccagaatatgaaaaagaactacatattgctttagaaaaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaat

SEQ ID NO: 183731 - DNA, 382 bp, Homo sapiens
  Payload ID: 16197
  Gene Symbol: SLC30A5
  Gene Name: solute carrier family 30 (zinc transporter), member 5
  ENST ID: ENST00000504103
  CDS Start-End: 168-382
tagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcggactgcattttttatggttttgtttcaaaagccattttcttctgggaaaactattaccaaacaccagtggatcaaaatatttaaacatgcagttgctgggtgtattatttcactcttgtggttttttggcct

SEQ ID NO: 183732 - DNA, 555 bp, Homo sapiens
  Payload ID: 16197
  Gene Symbol: SLC30A5
  Gene Name: solute carrier family 30 (zinc transporter), member 5
  ENST ID: ENST00000513937
  CDS Start-End: 1-196
actttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccatgcccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttag

SEQ ID NO: 183733 - DNA, 3999 bp, Homo sapiens
  Payload ID: 16197
  Gene Symbol: SLC30A5
  Gene Name: solute carrier family 30 (zinc transporter), member 5
  ENST ID: ENST00000621204
  CDS Start-End: 1469-2551
agacgcaaggctgggcactcccccgggagtgagggttgctgggcctgatgacgtggcttggcaacgtccctaccgccgctgcttcccgggaacctggcgccgccggaactgatcgcggcctagtcccgacgcgtgtgtgctagtgagccggagccggcgacggcggcagtggcggcccggcctgcaggagcccgacggggtctctgccatgggggagtgacgcgcctgcacccgctgttccgcggcagcggcgagacatgaggagaccccgcgacaggggcagcggcggcggctcgtgagccccgggatggaggagaaatacggcggggacgtgctggccggccccggcggcggcggcggccttgggccggtggacgtacccagcgctcgattaacaaaatatattgtgttactatgtttcactaaatttttgaaggctgtgggacttttcgaatcatatgatctcctaaaagctgttcacattgttcagttcatttttatattaaaacttgggactgcattttttatggttttgtttcaaaagccattttcttctgggaaaactattaccaaacaccagtggatcaaaatatttaaacatgcagttgctgggtgtattatttcactcttgtggttttttggcctcactctttgtggaccactaaggactttgctgctatttgagcacagtgatattgttgtcatttcactactcagtgttttgttcaccagttctggaggaggaccagcaaagacaaggggagctgcttttttcattattgctgtgatctgtttattgctttttgacaatgatgatctcatggctaaaatggctgaacaccctgaaggacatcatgacagtgctctaactcatatgctttacacagccattgccttcttaggtgtggcagatcacaagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctgctttttacctttgtggaattattctatggcgtgctgaccaatagtctgggcctgatctcggatggattccacatgctttttgactgctctgctttagtcatgggactttttgctgccctgatgagtaggtggaaagccactcggattttctcctatgggtacggccgaatagaaattctgtctggatttattaatggactttttctaatagtaatagcgttttttgtgtttatggagtcagtggctagattgattgatcctccagaattagacactcacatgttaacaccatgccatagccatgcccatggagcttctcaaggaagctgtcactcatctgatcacagccattcacaccatatgcatggacacagtgaccatgggcatggtcacagccacggatctgcgggtggaggcatgaatgctaacatgaggggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaagatacagaaaattgaaggattaatatcataccgagaccctcatttttggcgtcattctgctagtattgtggcaggaacaattcatatacaggtgacatctgatgtgctagaacaaagaatagtacagcaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatttgagcaccatgaaatcaaaataccctataactactttctatagtcatatctaatttatatttttttcatttccagttgtaactagatatgtagtaaagtctgaaaagactttaccatagacaataacatgcagttttatcagcaccaaagaatgttgtccaaaagaaactttttaatacctgtctttctatttataacatctgaatattttcattcttatattaagaattttgataagtagattgaatttagtatgagtactattttcttatatataccacaatggcaaacatgtattataaatcatatttttgtcttaccaattttaatatatgaggggttttagaaatttgttgtaagttatttttatattccttgtcttttgcatattttttggccaaaatcttcaatacatattaaaatttttgagtggtggg

SEQ ID NO: 183734 - DNA, 5089 bp, Homo sapiens
  Payload ID: 16198
  Gene Symbol: SLC30A6
  Gene Name: solute carrier family 30 (zinc transporter), member 6
  Uniprot ID: Q6NXT4
  ENST ID: ENST00000282587
  CDS Start-End: 38-1423
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggttttaaataatctttctttattcagtagctattaataatttatctcatattcagcgaatatttattgagaatattgttgagaatctcttacatgccaggcactatactaagttaatatgcattcagtataccagttggtgtgacccagaccaaaggtaacacaaagatgaatgagaattccttcaaggcgccgataatcctagtaggagagctaagacacaaaactgttgcatgtttttaatcatcaaattaaacttctttccacgtcctta

SEQ ID NO: 183735 - DNA, 4758 bp, Homo sapiens
  Payload ID: 16198
  Gene Symbol: SLC30A6
  Gene Name: solute carrier family 30 (zinc transporter), member 6
  Uniprot ID: Q6NXT4
  ENST ID: ENST00000357055
  CDS Start-End: 61-1359
gttctgggaaaactcgagcacccagaacggcttccggcgggagctgtgcagctccttatcatgtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggtttta

SEQ ID NO: 183736 - DNA, 2354 bp, Homo sapiens
  Payload ID: 16198
  Gene Symbol: SLC30A6
  Gene Name: solute carrier family 30 (zinc transporter), member 6
  Uniprot ID: Q6NXT4
  ENST ID: ENST00000379343
  CDS Start-End: 38-1543
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagagacggggtttcaccattttggctgggctggtctcaaactcctgacctcaagtggtccacccacctcggcctaccaaagtgctgggataacaggcgtgagctaccgtgcctgagcaatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaa

SEQ ID NO: 183737 - DNA, 4589 bp, Homo sapiens
  Payload ID: 16198
  Gene Symbol: SLC30A6
  Gene Name: solute carrier family 30 (zinc transporter), member 6
  ENST ID: ENST00000406369
  CDS Start-End: 40-1203
ggcttccggcgggagctgtgcagctccttatcatgtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttc

SEQ ID NO: 183738 - DNA, 2207 bp, Homo sapiens
  Payload ID: 16198
  Gene Symbol: SLC30A6
  Gene Name: solute carrier family 30 (zinc transporter), member 6
  ENST ID: ENST00000449777
  CDS Start-End: 38-133
agaacggcttccggcgggagctgtgcagctccttatcatggggacaattcatctctttcgaaaaccacaaagatccttttttggcaagttgttacgggaatttagacttgtagcagctgaccgaagggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaat

SEQ ID NO: 183739 - DNA, 573 bp, Homo sapiens
  Payload ID: 16198
  Gene Symbol: SLC30A6
  Gene Name: solute carrier family 30 (zinc transporter), member 6
  ENST ID: ENST00000440718
  CDS Start-End: 38-573
agaacggcttccggcgggagctgtgcagctccttatcatgtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctgg

SEQ ID NO: 183740 - DNA, 570 bp, Homo sapiens
  Payload ID: 16198
  Gene Symbol: SLC30A6
  Gene Name: solute carrier family 30 (zinc transporter), member 6
  ENST ID: ENST00000457724
  CDS Start-End: 20-388
agctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggcctgcttttctctgcatgtcctgttcagtctctcagaccacttttctccaccaatccgaaatgatgctcctatcaagaccttaattcacaccttctcaccttcatccgagagaggaaataataaattactactgttaaaataatatttatggtttgaaagattagaagtcctggctgtatttgcctccacagtcttggcacagttgggagctctctttatattaaaagaaagtgcagaacgctttttggaacagcccgagatacac

SEQ ID NO: 183741 - DNA, 4776 bp, Homo sapiens
  Payload ID: 16198
  Gene Symbol: SLC30A6
  Gene Name: solute carrier family 30 (zinc transporter), member 6
  Uniprot ID: Q6NXT4
  ENST ID: ENST00000435660
  CDS Start-End: 61-1377
gttctgggaaaactcgagcacccagaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagctttaactgcctatacttacctgaccatttttgatctttttagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagcacaatttgaatttttaattatcaagatttttgttaaagtttctctcctttaaaaattttagtacatttgtaaatagtccatggttctcagtgttttattttgattaagtgactacccaacttttggtgatatgcagtgaaagaatcccaattttctatgttacatttaatcaaatactgacataatgaatttatctttcctgacacattttcattcattggctttttaatttcttattttattaacaaaatatatcagatatattaccaaaacacatggagttccatacataatatggaatttgatgtcttttcaagttgcacaaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatgacctaggagggttttttattgttttattttattatgcattccataacagttttaaaatgggattttgagaatggacttaactttcctggaatccaatgctcctggagatttatgactttcccagccatcagccagctatctagagaagatttttgtttttcttttgcaacagtttcttcagtcaactcattcactttcaaataggagcagcactttgaaatcctttttcttcactgtggattaaaaacatccaagaagccatctctgtcaagcagaattgtcatctgtggtaataagtgaccatgtcctaaatacctttttcttagtgaggagttggtcattgtctttggcatctgcaacccctgttcaggcatgtgacctgctaaagaaatacagcctacactaccttgactactggggaaaatgatacttcgtaaaatgtaataaggcaacctgttccttggcctttatcttatgttttccaactattactgtatctgttattggtctactattacaggatgattcttcttcctccattgatctcaactaaatatgaattagggtcatgcatgaaatctgaactgccgtgtcctgagttatggttaagaggtatgtgctgccaccccatgcatgtcttccccatccccataggattttaaagtgttcaggtaccaaacacagttctgtgtgaggttttatgcctacttcctcaacaccaattcagaggcaacacctgtgcatctgtcccaccaaaggtgctttaatacctaccttcactatttgagaaaggacactcacagttgcctgtgggttatgaaagaattggccctacgtcctgcatgtaagatgttacaggggacattgggccaggcattattatatagagaagtcttatttgccaagctctgactaacttctggatatgaaaataaggaacttgcccagcataggcctataggcagcagccttactagtaaatcttgccacagaatcacttgaagctagacagagaaagaagttcaatttaaatatttgtcccattgtttgtgattaggatgtaagctttgtggaatgtaattaaccctgctttacgaagtcaccatattataataggaaaaacactgcctaggaggcaagagatctgaattccagttctgatgctgccactgtgtaaggaagtagttttataacccatgggcaaatcatctgagctttctcatctgtaaagttagggagaggaattaattagttgatctgtaaaataatcagcttcaaaacgttatggctaaatctgtagaatgtatgcccaattgctaaacggatgttgtgcccagaattttatctagtgactacctcaacatacaggccaagcgttacctacaccaacacccaagccattaatttgaggtgccatgagaataggtgaaccacagcctaacaccatttaggtttttgtgtttttttcaggcttgcctctacttaaatatatttagatgagagagttctcttagacttctttctttgtaaggaagggttatttggggaagtgttggaaaaaagattagggcagggtacccttagtttatatagggtacaaaagaatgggaaacatcttccctttcttctttaatctctgaagtcatgtttggaattacatataatgtagcaggtactggagaggacctgaatttcaagcttctgatttagctgtttgtaaacttccaagttttgcttgactaaagaatgctgatcttttttgggagtctgatctccttctaatatcagaaagtgctttttatattccagattgcttgaattaaactgtttggattaaagaacatatatggagtttcctctctggtttta

SEQ ID NO: 183742 - DNA, 2359 bp, Homo sapiens
  Payload ID: 16198
  Gene Symbol: SLC30A6
  Gene Name: solute carrier family 30 (zinc transporter), member 6
  ENST ID: ENST00000454324
  CDS Start-End: 38-217
agaacggcttccggcgggagctgtgcagctccttatcatggggacaattcatctctttcgaaaaccacaaagatccttttttggcaagttgttacgggaatttagacttgtagcagctgaccgaaggtcctggaagatactgctctttggtgtaataaacttgatatgtactggcttcctgcttatgtggtgcagttctactaatagtatagtttaatgacatgtttaataagttactgggtaacattgaggaaacctagccctgtctattcatttgggtttgaaagattagaagtcctggctgtatttgcctccacagtcttggcacagttgggagctctctttatattaaaagaaagtgcagaacgctttttggaacagcccgagatacacacgggaagattattagttggtacttttgtggctctttgtttcaacctgttcacgatgctttctattcggaataaaccttttgcttatgtctcagaagataatttaagtattttcttcttaaagctgctagtacgagctggcttcaagagcatgttgcagatcttagtcgaagcttgtgtggaattattccgggacttagcagtatcttccttccccgaatgaatccatttgttttgattgatcttgctggagcatttgctctttgtattacatatatgctcattgaaattaataattattttgccgtagacactgcctctgctatagctattgccttgatgacatttggcactatgtatcccatgagtgtgtacagtgggaaagtcttactccagacaacaccaccccatgttattggtcagttggacaaactcatcagagaggtatctaccttagatggagttttagaagtccgaaatgaacatttttggaccctaggttttggctcattggctggatcagtgcatgtaagaattcgacgagatgccaatgaacaaatggttcttgctcatgtgaccaacaggctgtacactctagtgtctactctaactgttcaaattttcaaggatgactggattaggcctgccttattgtctgggcctgttgcagccaatgtcctaaacttttcagatcatcacgtaatcccaatgcctcttttaaagggtactgatgatttgaacccagttacatcaactccagctaaacctagtagtccacctccagaattttcatttaacactcctgggaaaaatgtgaacccagttattcttctaaacacacaaacaaggccttatggttttggtctcaatcatggacacacaccttacagcagcatgcttaatcaaggacttggagttccaggaattggagcaactcaaggattgaggactggttttacaaatataccaagtagatatggaactaataatagaattggacaaccaagaccatgatagactctaacttatttttataaggaatattgactccttggcttccaatttatttagtaatccaactttgcattgactgtttaatcatttactctaaatgttagataatagtagtcttgttcacatttcatgaaacctatgaaactatatttttgtaaaatgtatttgtgacagtgaaatcctcgtaaatgttaaaggctttaaataggcttcctttagaaaatgtgtttctttaaatttggattttggtatctttggttttgtagttgactgcagtgtgatgtgaccttacctttataagagccacttgatggagtagatctgtcacattactaagatacgatatttctttttttttccgagacggagtcttgctctgccactgtgcccggccaatacattattattaacttaaggctgtactttattaaggcttccttagtttttgttttgttttgttttttgagatggagtctcactctgtcgcccaggctggaatgcagtggcatgatctcagctcactgcaacctctgcctcctgagttcaaatgattctcctgcctcagcctcccgagtagctgggattacaggcacctgccaccacgcccagctaatttttgtatttttagtaaagacgggggatttcaccatgttggccaggctggtcttgaactcctgacctcatgatccacccaccttagcctcccaaagtgctgggattaggtgtgagccaccgcacctggccgatattttctttaatgaaatttataaatatgcttcttgaataatacacattttgggaaagggaaaaatgtctgttcaaaaagtaaaagtctcttttatagcttttccaaacttaattgctaaatttttctttgaggttctcctgaattatgtcttacaaactaaaagcaaaaatttttagcagaaattttggaatacattctatctagc

SEQ ID NO: 183743 - DNA, 1281 bp, Homo sapiens
  Payload ID: 16199
  Gene Symbol: SLC30A7
  Gene Name: solute carrier family 30 (zinc transporter), member 7
  Uniprot ID: Q8NEW0
  ENST ID: ENST00000357650
  CDS Start-End: 10-1140
gcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctggtactgtacgatccaaaacattgtacccagctttttaaaagagagaaattatcactacaactcccgagcactaagtagacggggtagagtcagccg

SEQ ID NO: 183744 - DNA, 623 bp, Homo sapiens
  Payload ID: 16199
  Gene Symbol: SLC30A7
  Gene Name: solute carrier family 30 (zinc transporter), member 7
  ENST ID: ENST00000370111
  CDS Start-End: 1-262
tgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggaaactggaagaggaaaatgagaatctgtaaaacttgaagctgtcctcatcgggccagatggataaagcaaaatgacttttttttcttttttttttctgttagactgagcttttgtggaaagctgtaagccctcaggggaaggatatcagcttgagtaattaactcatgattatgcaaagaaaatttacctagcctctttgtttttcctttctttgttattgccttgggctacttcattttttattaccatcttctctgtttagggctaggagtaaggaaaatgacagagacaataaaaagagcccaagttttgcccattttgctttcactaacaatgttgttgaaaaataaaagaaattaagacaatttatttgaacaata

SEQ ID NO: 183745 - DNA, 7898 bp, Homo sapiens
  Payload ID: 16199
  Gene Symbol: SLC30A7
  Gene Name: solute carrier family 30 (zinc transporter), member 7
  Uniprot ID: Q8NEW0
  ENST ID: ENST00000370112
  CDS Start-End: 188-1318
gcgcggcccgggccggaagtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaaatggagagataatgatgctttctcctatgggtatgttagagcggaagttctggctggctttgtcaatggcctatttttgatcttcactgctttttttattttctcagaaggagttgagagagcattagcccctccagatgtccaccatgagagactgcttcttgtttccattcttgggtttgtggtaaacctaataggaatatttgttttcaaacatggaggtcatggacattctcatggctctggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttggaagtattggtgtaattgcttctgccatcatgatgcaaaattttggtctgatgatagcagatcctatctgttcaattcttatagccattcttatagttgtaagtgttattcctcttttaagagaatctgttggaatattaatgcagagaactcctcccctattagaaaatagtctgcctcagtgctatcagagggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggctggagtgagacagctctacgtacagattgactttgcagccatgtagtgaatggaaagaaattatgcaccttttatggaccaaatttttctgccagtaagaatttcagttgtgggcctccagtcttctggaatgtcttcactgcagctgctggaaatcactgctttcattcccacaaaaccagtattacttttttttaaaaaaagaaagaaattggaaatctgtgctatacgtaatgtcataattgttgacgttcttcagtataatcatgtttgttaaattgtttgtaccttgcaaacttatgaaccaaaccatattgggttttcaaagtgcctttgtatccaaaaatgtatttgccagcatagaaatgtaccatcaagagtcatgtatgttttatttttgtttttattttttattttttgagatggagtctcgctctgtagccaggctggagtgcagtggcataatctcagctcactgcaacctctgcttcccgggttcaagctattctcctgcctcagccttctgagtagctgcgactatgggcgtgtgccaccatgcccagctaatttttgcatttttagtagagatggggtttcaccatgttggccaggatggtcttgatctcttgacctcgtgatccgtccacctcagcctcccaaagtgctgggattacaggtgtgagccaccacgcccggctatgtttttttttttttttttttttttttttaacaatggatattctgtaaaatatcctgtacaaaacaagactattgccagtaatgtatacaaattgtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttaggctttgcacaaatacaattgctttcaggaatcctaaagcagcattttattgagtttgaattattaaaggtacagaggaaatgtggtgatgtagaacttttcctaacacaggtatctaggaagtaagtgctgagttgattttctaggttcttacgtatttgaaaaataaaattgcaattcgagataagtgcttgagcactctacttaagtattctctgtgttttatgaagagaaaatgatctgattttcccttatacttcattttacaatacatattcccttttaacttaaaaaaattgtaaatgtgggagaaaaaaccctgcaggatggaaacaattattaagaatgtagatcaataagtactttttagtgatgtggcagaaatccctgttgattctaagttttagagtgtcttttcccctatttctgacctacaactataaactactctctattaggagaactagaccactttcttcattcttttctaaactgctgcagattgccgtgaactctatcaatagtctcttttccgcaggcaaagtggcattttctaaacatgtttgcttactgccaggtggtttgaaatctatgatttactgcagtagtatgtgcttaaaacaactgttgaggtcttttaagcaggaaagttcaaaaggaagtgtcctgataatggtactggtttttctacaaatataagtagtcattagaagtttgcaaccaccaccaagtctgagagaactctgggatattctgtgggttttggcatattagatagagaaaatgacagatctagatgaagggagcttttggatgtgtgcctttaaaaactgattatgtataaatactgatatttcacatacggagatatttgaagacccaagtctgcctttcacagagccctccattccaagtttagtttttgtcaaaatatgaatcattttatttgactgtactatcagtacacaaatgcatgagtatgtttatacagtgttagactgatgtgaatttgcatttgttacattacattgccagcgcatatcatttagcaagttggcattaacatttatgctttaattaaatgccagtatacctatgtgtgcagcagtaaaaaattagtgagaaaaagcaactttttgtcactcttaggaaatattttgtcttattagtgttcttggcacatgtatattactaaagtagataattccaatgagaaatactaccagattattgttataaaattaatttacaatgtccctgatattgagctaactcttaaaaaaaccaaacaaaactcgtatctgagtgtaactttgccaatattttaaaagccaaaatattctctggacaacaaatttgtattgctcagggacagtttaccttgcctggtaaaccttcccaaacagaaatatagctatactatctttggttttgtttttttgttttttttgtttgtttgtattagatggaatttcactcttgtcgcccaggctggagtgtagtggcgcagtctcagctcactgcaacctccacctcccgggttcaagtgattctcctgtctcagctccctgagtaactggaattacaggtgcacgccaccacgcccggctaatttttgtgtttttagcagagacagggtttcaccacgttggccagggtggtcttggactcctgacctcaggtcatcctcctgcctcggcctcccaaagtgctgagactacaggtgtgagccaccgtgctcagccactagctttggttttttaaacatagattatattcctcaagatgaagggcttaacatatccacagcttcctcagtttgctaactccccatgcatctttgtgaaggacagtatctagtttatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgcttagtttctttattttgtttatggtctctgaactggtatttttttataaaccaggctaattcacaggtcataccatttcattcttgtcgtgttggcttccagtcactggaaaagcttttgcattttaaagatttttagagccatgcaaaactgggcattaaatgttgcataaagcaaatcttttaagtaaggtaaaatgttgaagtcttaaccagaattcctacaactaattactaaaactgctatttctaactcttcatgaaagcattacctttggaaagttaaactttttttttcctttcatcaccgtctttgaaacaaattattttccaattcataagaactttggtaaaaaaaaaaataaaaggaaattatatgtttttctttggacattcattggaaggcttgttgaagacatgatcccccagaagccttagtgacccagatctcaaccagagactcaagatagcctcaaatacagtgaaagattatgtatccaaaaaaaaaaaaaaaaaaaaaagaaaaggagcagggaaggacagttctagttaaagccaaatggatgtgagtctgacaagggtgtctttgatttatatttcctaactgcaaattacacagaaagtgagaatggggaataacttttattaagtatttatgtgccaggcggttagtgtggccttcatgttattacatttaatcctcaaatttctacaaaggaataattttgcatgattttatgattgacggagcattttcaaatctcctctaattctcataacatctctgtgaggaaggaatttttatccttattttacagatgaggaagctgtttggagataatttaagtgacttgcctggggaatctagccagtagtagagtactgattaatcaggtgctgacatctgctctgctttgtgtatgtaattcagcagtgcttcaaagatccaagaagctgtagcagatctcaatacactctcctataaaattagtgaataatcaccatgacaaaattggtatggcggaacagtcattatacattatttagactcattccttcttccagtgcccttatgattatttcctacctttaccattgatcttaaactgtgcaggctaaaaagaggaaccagaactcccttaagcacttttaagactatttaaaaaataaagttttgttggcattgaagagtaagctgcttaagggactgaatgaaaagatagtaccctttgtggctgtatgaagagagaaactgaatttctatccaagagaccttaatttagtttattagggaattatcttccccaaaagtacaagtaattttgcactgcaggagaaggataagtagatttgatttacatcacattttatacacacctttcaaaaggaagaaatctgtttcataaatagtagtaatctatgcttaaacttaacatttaatgttgacttcttacaacagccttgaaaattatttgtaattttgatcatgatgttggaaagcttgtaataaagaatatctttctcttctgcatccttttatcctcaaacttagcatggattcacatgctgagtaaatgtttggttaactagtgaacattttagatagttgtgtcaaaaataagggttagggataggtaaaaccagtaatttactgttttttacagaagacatctcagcatttctttggcatttttgcacaaataaatgactatatattcaccttggccatttttttttttaagtagccctatgagctgctcattctttttcatatacagtggaagtatacagatgttatccattttacaaattgttggatcggaatttgacagaattgggactgtggaacctgggtcacttgaattttctatattttgtatggccaaatcaggaaccagacagtctccatagtctcctttgtttttatggaaaattgccatattcacatatttcatttatcctaatgtattgtcatccaaaatgaaagaggtctttcttgaaggtgctttaaagacatcactacatgtattcaattactgatttaaatattcccagaattattttttacctttctctttttcctctcaaacacaaaattttagtagtacctccctctatttcttcactgatttttcatctgttttcattgttatttccactatagaacttctactttatactagcggggaaaatttttttatttagaattttaatatttgaattttgtttatgtatcacatactgtgctacagttagcctcaatgaagattctattttgaactagacatcctgtcaatagtttgtcaagtaacttcattgcttcctttgatagcaattcagtgaaattttttcccaagtgatattttcccccaacttttgtgagtttgataaataggatgagtcttttatattggaaatactgtgaatggaaaattgccaaatcccttcttagtatattttaagcaccctacaacactttacctccctgcctttagtggtatttaaacatatggccaagttagtatttgggtttgattcctttggtgaagattaaggcatcaaaacatttcttaaaatgtttgagtacaaggctaagttataatgtcaactttcaaagactatgttgtgattcggtttgaatatgctgaagtgagcaattatgatttgcccaagtgcaatacaacaaatctataatgtatatttcacattttctacttgaacacattcatgtatatattttgttaaacttcatatgtatttaaaaagaatcatgaactgtatcaaaattctttcaataaaatttctatttaaaaatc

SEQ ID NO: 183746 - DNA, 5430 bp, Homo sapiens
  Payload ID: 16200
  Gene Symbol: SLC30A8
  Gene Name: solute carrier family 30 (zinc transporter), member 8
  Uniprot ID: Q8IWU4
  ENST ID: ENST00000427715
  CDS Start-End: 435-1397
ttttaagaagcatcaagaaagcctgcctgtctaactttggaaatatcaccctcatgctgtcttcccaggatgtctctctccctaagtaagagatgttacttcctggagggaatgcagtgttgggaatctgaagacccagctttgagctgaatttgctttgtgatacctggagagaagacgtgttttcttgacaacagcacagtacctagtgagttcaacaacaacgacaacaacagccgcagctcatcctggccgtcatggagtttcttgaaagaacgtatcttgtgaatgataaagctgccaagatgtatgctttcacactagaaagaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactagaaacctagcaggcattaataattgttgaggcaatgactctgaggctatatctgggccttgtcattatttatcatttatatttgtatttttttctgaaatttgagggccaagaaaacattgactttgactgaggaggtcacatctgtgccatctctgcaaatcaatcagcaccactgaaataactacttagcattctgctgagctttccctgctcagtagagacaaatatactcatcccccacctcagtgagcttgtttaggcaaccaggattagagctgctcaggttcccaacgtctcctgccacatcgggttctcaaaatggaaagaatggtttatgccaaatcacttttcctgtctgaaggaccactgaatggttttgtttttccatattttgcataggacgccctaaagactaggtgacttggcaaacacacaagtgttagtataattctttgcttctgcttctttttgaaaatcatgtttagatttgattttaagtcagaaattcactgaatgtcaggtaatcattatggagggagatttgtgtgtcaaccaaagtaattgtcccatggccccagggtatttctgttgtttccctgaaattctgcttttttagtcagctagattgaaaactctgaacagtagatgtttatatggcaaaatgcaagacaatctacaagggagattttaaggattttgagatgaaaaaacagatgctactcaggggctttatgaaccatccatcaattctgaagttctgactctcccattaccctttccctggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagcagtgcatagcatgtagtgttcagtacatgttaaatgttgttttttattatgtacaaacatgagtgggcacagaattttaaatcatctcaacttttgagaaattttgagttatcaacaccgttcccacaagacagtggcaaaattattggtgagaattaaacagctgtttctcagaggaagcaatggaggcttgctgggataaaggcatttactgagaggctgttacctagtgagagtgatgaattaattaaaatagtcgaatccctttctgactgtctctgaaagcttccgcttttatctttgaagagcagaattgtcactccaaggacatttattaataaaaagaacaactgtccagtgcaatgaaggcaaagtcataggtctcccaagtcttaccccattcctgtgaaatatcaagttcttggcttttctctgtcatgtagcctcaactttctctgaccgggtgcatttctttctctggtttctaaattgccagtggcaaatttggatcacttacttaatatctgttaaattttgtgacccaacaaagtcttttagcactgtggtgtcaaaaagaaaaacacctcccaggcatatacattttatagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgtgtgttgtttaaaataaaatcaagaaagagaga

SEQ ID NO: 183747 - DNA, 2520 bp, Homo sapiens
  Payload ID: 16200
  Gene Symbol: SLC30A8
  Gene Name: solute carrier family 30 (zinc transporter), member 8
  Uniprot ID: Q8IWU4
  ENST ID: ENST00000456015
  CDS Start-End: 1-1110
atggagtttcttgaaagaacgtatcttgtgaatgataaagctgccaagatgtatgctttcacactagaaagtgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaa

SEQ ID NO: 183748 - DNA, 549 bp, Homo sapiens
  Payload ID: 16200
  Gene Symbol: SLC30A8
  Gene Name: solute carrier family 30 (zinc transporter), member 8
  ENST ID: ENST00000524274
  CDS Start-End: 287-549
ttttgttttttggcaactggaagcagtggggatgaaatattttcctaaggcgtctcaggactgaactggcagcaaaatagatgtctctctccctaagtaagagatgttacttcctggagggaatgcagtgttgggaatctgaagacccagctttgagctgaatttgctttgtgatacctgaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggca

SEQ ID NO: 183749 - DNA, 1393 bp, Homo sapiens
  Payload ID: 16200
  Gene Symbol: SLC30A8
  Gene Name: solute carrier family 30 (zinc transporter), member 8
  Uniprot ID: Q8IWU4
  ENST ID: ENST00000521243
  CDS Start-End: 321-1283
gggctgccagcatgctgtcacctctcaataggagatcagttaatgcatactgaaggaaggcttgttggagaagaatcctctcctgaaccctgtggagactctagaatcctgcggatgtctctctccctaagtaagagatgttacttcctggagggaatgcagtgttgggaatctgaagacccagctttgagctgaatttgctttgtgatacctgaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatg

SEQ ID NO: 183750 - DNA, 5242 bp, Homo sapiens
  Payload ID: 16200
  Gene Symbol: SLC30A8
  Gene Name: solute carrier family 30 (zinc transporter), member 8
  Uniprot ID: Q8IWU4
  ENST ID: ENST00000519688
  CDS Start-End: 247-1209
tttgcttccaaaactgggcagtgagttcaacaacaacgacaacaacagccgcagctcatcctggccgtcatggagtttcttgaaagaacgtatcttgtgaatgataaagctgccaagatgtatgctttcacactagaaagaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtcacagatgctgcccacctcttaattgacctgaccagtttcctgctcagtctcttctccctgtggttgtcatcgaagcctccctctaagcggctgacatttggatggcaccgagcagagatccttggtgccctgctctccatcctgtgcatctgggtggtgactggcgtgctagtgtacctggcatgtgagcgcctgctgtatcctgattaccagatccaggcgactgtgatgatcatcgtttccagctgcgcagtggcggccaacattgtactaactgtggttttgcaccagagatgccttggccacaatcacaaggaagtacaagccaatgccagcgtcagagctgcttttgtgcatgcccttggagatctatttcagagtatcagtgtgctaattagtgcacttattatctactttaagccagagtataaaatagccgacccaatctgcacattcatcttttccatcctggtcttggccagcaccatcactatcttaaaggacttctccatcttactcatggaaggtgtgccaaagagcctgaattacagtggtgtgaaagagcttattttagcagtcgacggggtgctgtctgtgcacagcctgcacatctggtctctaacaatgaatcaagtaattctctcagctcatgttgctacagcagccagccgggacagccaagtggttcggagagaaattgctaaagcccttagcaaaagctttacgatgcactcactcaccattcagatggaatctccagttgaccaggaccccgactgccttttctgtgaagacccctgtgactagctcagtcacaccgtcagtttcccaaatttgacaggccaccttcaaacatgctgctatgcagtttctgcatcatagaaaataaggaaccaaaggaagaaattcatgtcatggtgcaatgcacattttatctatttatttagttccattcaccatgaaggaagaggcactgagatccatcaatcaattggattatatactgatcagtagctgtgttcaattgcaggaatgtgtatatagattattcctgagtggagccgaagtaacagctgtttgtaactatcggcaataccaaattcatctcccttccaataatgcatcttgagaacacataggtaaatttgaactcaggaaagtcttactagaaatcagtggaagggacaaatagtcacaaaattttaccaaaacattagaaacaaaaaataaggagagccaagtcaggaataaaagtgactctgtatgctaacgccacattagaacttggttctctcaccaagctgtaatgtgatttttttttctactctgaattggaaatatgtatgaatatacagagaagtgcttacaactaatttttatttacttgtcacattttggcaataaatccctcttatttctaaattctaacttgtttatttcaaaactttatataatcactgttcaaaaggaaatattttcacctaccagagtgcttaaacactggcaccagccaaagaatgtggttgtagagacccagaagtcttcaagaacagccgacaaaaacattcgagttgaccccaccaagttgttgccacagataatttagatatttacctgcaagaaggaataaagcagatgcaaccaattcattcagtccacgagcatgatgtgagcactgctttgtgctagacattgggcttagcattgaaactataaagaggaatcagacgcagcaagtgcttctgtgttctggtagcaactcaacactatctgtggagagtaaactgaagatgtgcaggccaacattctggaaatcctatgtcaatgggtttggtttggaacctggacttctgcatttttaaaagttacccagagatgcttctaaagatgagccatagtctagaagattgtcaaccacaggagttcattgagtgggacagctagacacatacattggcagctacaatagtatcatgaattgcaatgatgtagtggggtataaaaggaaagcgatggatattgccggatgggcatggccagtgatgtttcacgtcattgaggtgacagctctgctggactttgaattacatatggaggctctccaggaagacgaagaagagaaggacattctaggcaaaaagaagactaggcacaaggcacacttatgtttgtctgttagcttttagttgaaaaagcaaaatacatgatgcaaagaaacctctccacgctgtgatttttaaaactacatactttttgcaactttatggttatgagtattgtagagaacaggagataggtcttagatgatttttatgttgttgtcagactctagcaaggtactagaaacctagcaggcattaataattgttgaggcaatgactctgaggctatatctgggccttgtcattatttatcatttatatttgtatttttttctgaaatttgagggccaagaaaacattgactttgactgaggaggtcacatctgtgccatctctgcaaatcaatcagcaccactgaaataactacttagcattctgctgagctttccctgctcagtagagacaaatatactcatcccccacctcagtgagcttgtttaggcaaccaggattagagctgctcaggttcccaacgtctcctgccacatcgggttctcaaaatggaaagaatggtttatgccaaatcacttttcctgtctgaaggaccactgaatggttttgtttttccatattttgcataggacgccctaaagactaggtgacttggcaaacacacaagtgttagtataattctttgcttctgcttctttttgaaaatcatgtttagatttgattttaagtcagaaattcactgaatgtcaggtaatcattatggagggagatttgtgtgtcaaccaaagtaattgtcccatggccccagggtatttctgttgtttccctgaaattctgcttttttagtcagctagattgaaaactctgaacagtagatgtttatatggcaaaatgcaagacaatctacaagggagattttaaggattttgagatgaaaaaacagatgctactcaggggctttatgaaccatccatcaattctgaagttctgactctcccattaccctttccctggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagcagtgcatagcatgtagtgttcagtacatgttaaatgttgttttttattatgtacaaacatgagtgggcacagaattttaaatcatctcaacttttgagaaattttgagttatcaacaccgttcccacaagacagtggcaaaattattggtgagaattaaacagctgtttctcagaggaagcaatggaggcttgctgggataaaggcatttactgagaggctgttacctagtgagagtgatgaattaattaaaatagtcgaatccctttctgactgtctctgaaagcttccgcttttatctttgaagagcagaattgtcactccaaggacatttattaataaaaagaacaactgtccagtgcaatgaaggcaaagtcataggtctcccaagtcttaccccattcctgtgaaatatcaagttcttggcttttctctgtcatgtagcctcaactttctctgaccgggtgcatttctttctctggtttctaaattgccagtggcaaatttggatcacttacttaatatctgttaaattttgtgacccaacaaagtcttttagcactgtggtgtcaaaaagaaaaacacctcccaggcatatacattttatagattcctggagaatgttgctctccagctccatccccacccaatgaaatatgatccagagagtcttgcaaagagacaagcctcattttccacaattagctctaaagtgcctccaggaaatgattttctcagctcatctctctgtattccctgttttggatcacagggcaatctgtttaaatgactaattacagaaatcattaaaggcaccaagcaaatgtcatctctgaatacacacatcccaagctttacaaatcctgcctggcttgacagtgatgaggccacttaacagtccagcgcaggcggatgttaaaaaaaataaaaaggtgaccatctgcggtttagttttttaactttctgatttcacacttaacgtctgtcattctgttactgggcacctgtttaaattctattttaaaatgttaatgtgtgttgtttaaaataaaatcaagaaagagaga

SEQ ID NO: 183751 - DNA, 587 bp, Homo sapiens
  Payload ID: 16200
  Gene Symbol: SLC30A8
  Gene Name: solute carrier family 30 (zinc transporter), member 8
  ENST ID: ENST00000518396
  CDS Start-End: 479-587
acaattgaatcagatatcatatgaaagacatacacacttcatgtaatgctacctgcaagtctccctagaaaagcagtttttgtaggtgaaaacaatgaagccaggtaatattgcaaggaggctgtaattttagcagacctaccaacaacactgatgtaggaagctcattattttaatttctggagccttttaattttttctttagaaagtgtataaataattgcagtgctgctttgcttccaaaactgggcagtgagttcaacaacaacgacaacaacagccgcagctcatcctggccgtcatggagtttcttgaaagaacgtatcttgtgaatgataaagctgccaagatgtatgctttcacactagaaagaaggagctgcaaatgaacacttcatagcaatgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatga

SEQ ID NO: 183752 - DNA, 823 bp, Homo sapiens
  Payload ID: 16200
  Gene Symbol: SLC30A8
  Gene Name: solute carrier family 30 (zinc transporter), member 8
  ENST ID: ENST00000518521
  CDS Start-End: 668-823
tctgacagctgcttagaggtcatcttagaactaaattccaaagaaataattttaggctgataaagagtccagaaaaaggaggagggagagaaaaagaaagaattagtttagtgtagcgaatggtagctatttgcagctcacccacgtgtgctccgaaggtcaaaaccctacatcagcaatttgtagcaagctcttgagctcctctacctcttagaaagcacaattgaatcagatatcatatgaaagacatacacacttcatgtaatgctacctgcaagtctccctagaaaagcagtttttgtaggtgaaaacaatgaagccaggtaatattgcaaggaggctgtaattttagcagacctaccaacaacactgatgtaggaagctcattattttaatttctggagccttttaattttttctttagaaagtgtataaataattgcagtgctgctttgcttccaaaactgggcagtgagttcaacaacaacgacaacaacagccgcagctcatcctggccgtcatggagtttcttgaaagaacgtatcttgtgaatgataaagctgccaagatgtatgctttcacactagaaagtgtggaactccaacagaaaccggtgaataaagatcagtgtcccagagagagaccagaggagctggagtcaggaggcatgtaccactgccacagtggctccaagcccacagaaaagggggcgaatgagtacgcctatgccaagtggaaactctgttctgcttcagcaatatgcttcattttcatgattgcagaggtcgtgggtgggcacattgctgggagtcttgctgttgtc

SEQ ID NO: 183753 - DNA, 6218 bp, Homo sapiens
  Payload ID: 16201
  Gene Symbol: SLC30A9
  Gene Name: solute carrier family 30 (zinc transporter), member 9
  Uniprot ID: Q6PML9
  ENST ID: ENST00000264451
  CDS Start-End: 181-1887
acttccgctacctccacggcaggcgtcgctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacatggttccctgtagtcatccatatattggtaccctgagtcaagtaaagttgtactccacaaatgttcagaaagaaggacagggatcacaaacactcagagtggaaaaagtaccatcatttgaaacagcagaaggtataggcacagaactcaaagctccacttaagcaagaacctctccaagtaagagttaaagcagtccttaagaaaagggagtatggctcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcagttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttcttttttttttttttactattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttcccaagacgaccctcaaagttaatgtgcagcaggtattccaaatggtaattttttttttttaggattccctaataaaaaaaaaaaaaattctgatatttctttttaaatctgattttggttgaggtcataccattcttaaataataattgaaggtttatgttgccatcttttctaattctgttttgcactgataaacttacataaagtttgtttatgtaaaataagacataaaggagtacaacatatcaaggaatttgagtatttatgtggaatcaggaaatttttctagagtcactgaattttcaaatcagagaatttgggctggatatggtggcttatgcctgtaatcccagcactttgggaggccgaggcaggaggattgcttgagctcaggaggtcaagaccagcctgggcaacacagcgagacctcatctctactaaaaaaagttagccgggtgtggtggtgctcacctgtgttagtccattctcacactgctataaagaaatacctgagactgagtaatcaaaaaaagagctttaattggctcatggttctgcagactgaacaggaaacatagcagcttctgcttctggggaggcctcgggaaacttcattcatggcagaatacgaaggggaagcagtcatagccagaggaagagcaagaggcggggattgggggtaggtgccacactcttgtaaacaaccagatctcatgagaactcactatacagtaccaagaggggaaggtgctaaagtattcatgagaactccacccccgtgatccagtcatctcccaccaggccctacctccaacatgggattacaattcgacatgagatttggtggggacaaagatccaaagcatatcagcatctgtagtcacagctacttgggaggccgaggtgggaggatcacttgagccccagaggtcgaggctgcaatgagctatgatcatgccactccagcctgaatgacagagtgagatcctgtctcaaaaagagaatttgggtctctttctccaaaaataaggctatatttagtttttcaggtttcttgttattttaccaaattaatgtttcttactttgtatctactttggcatatagcatttgagtattaaagcatataaatcatttttaaggaaaatattctctgcaggagaataattacaaaaataatactggacagaggaggggcagtcaagggtccatgattgattccttcttgcccaaaactaaaatctaggatttatcaaaggtgaggtatacagtggtccctgacttataatggttgcacttaagaatttttatgatgggtttattggcacataacccaataataagtaaaaagcatctgtacctacttttagctttggctgagaatggatctctaattcactgtaagtagcagtccccaaactatataaggtggcacagttttcatcatggcagtgggaggatgaggggtggagtgtttttgttttttttgtttttttttgagacagagtttcgttcttgttgcccaggctggagtgcactggcacaattgcagctcaccgcaaccttcacctcccgattcaagtgattctcctgcctcctgagtagctgggattacaggcatgcgccaccacacccggctaattttgtatttctggtttagacaaggtttctccatgttggtcaggctggtcttgaactgccgacctcaggtgatccgccctcctcggcttcccaaagtgctgggattacaggtgtgagccactgctccggtgatctgtttttaagtggagtatcctgggggcctatagtatccaactccaaagaggtaagttcctgaacatacactaaagaacctgtgagataagatcagacggaaaaattttcaaattttttcaaaagcaaaggtaatccctgcatacatcctcctacacacacacacatagtgcaaagtgaataacaaaatgtcataaggcttgagtttttggtatatggctttcagtgttaccttatctcataatttaggtaatgatttttgctaaaatgataaccatctaaagagtgcctaagttttaagtctcgtaactttttgaggaagaatgctgggaactacagaaaactgcataggcatttagaatttgtattatcttcttagactgcatttgtcaagctttggcagcatttcttttaaatgtgatgaaccccaatttgccaaactgtcagaagtcagtgaagcaaagaatcgaaggtaaaatgttgattcaaagattgtctcccctaaatccttcatttctttctctgaaatggaactttggaagccatttatatagattagtctgacagcctttatatttgcatgtaagtttacttgcatccttagacttggctttatgcaaaaagaaaatttttattcgttatattgtatttcatctgtctgatttccctggcacattaagatggtcctggtccctcaggatactttttcccttaataaatgtcatatgtaaataaaggcaa

SEQ ID NO: 183754 - DNA, 2217 bp, Homo sapiens
  Payload ID: 16201
  Gene Symbol: SLC30A9
  Gene Name: solute carrier family 30 (zinc transporter), member 9
  ENST ID: ENST00000513699
  CDS Start-End: 151-510
aaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacatggttccctgtagtcatccatatattggtaccctgagtcaagtaaagttgtactccacaaatgttcagaaagaaggacagggatcacaaacactcagagtggaaaaagtaccatcatttgaaacagcagaaggtataggcacagaactcaaagctccacttaagcaagaacctctccaagtaagagcccaagaaaggaataatggcaaataagaatcatcaattgcattatcatttttagaagagtaaggcaattaaagaacaagaggcccacacttttcagctactgcttattcaaatccagttaaagcagtccttaagaaaagggagtatggctcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccata

SEQ ID NO: 183755 - DNA, 3650 bp, Homo sapiens
  Payload ID: 16202
  Gene Symbol: SLC30A10
  Gene Name: solute carrier family 30, member 10
  Uniprot ID: Q6XR72
  ENST ID: ENST00000356609
  CDS Start-End: 212-883
actgcccccgccactcctttagactctggacgtgcggggactggtggcgctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcagaacttatacacaacacaaggtttcttctttgaatgcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctgggactggggctcaatagctgcggatacagtgttcaaagaagttcttgtttctaaactgattagaacttctagctaatgctcaggtgagatcatagcttaaatacattgaaaaaactaaagtaccacaatagctgtatttttcccaatccccttaacgatcataaaagaggcaagttaagtatttctggcactgaagaaatatcttttttctttgattcatttttgaataaatataaaatgaataactattaaggtagaaaatattctcagaacattctagaggaggtaaaggttagtaggagggcgttggccatctctacattttgtgaggtgagagaaaactaatgtttactttctgctgtgaactgaactgcagctatagaatgtttcaaatgcttaaatatataatacatttttttccatggaagtgagggaatatttcagtttcctgaagtatgacacaaatactcatatactgtcttttagagtcagtatagttggagctgttttcatttagtgctttgataatgatttacttatttttccaaatttcgtttgaattttctttcatatgattgcattgatctatgcagcatttaccagaaaagagtattcctgggatagcagaatgcataacactgagtgttaattcttgtgaaataaataagctagactgccttctctttaattagacatattttaaagtatttattatagttgtcaactagtaactcaatgaaaaagttgatgcccaagggagaaatgagaattagcttaattgctgcctttaatgtgtttttgaggaacttaaaattttctttcatgtcgctgatccatattaccaagttcaaataaaatttttataatcggattcagacccataaccaaactatgttggtagtagagaagcatctgtcatgtttttaacacattgctcagacatcagtatttaaatcagaacagtctcacaggtatgagaaaatgggaagtgcctcactagacaactagtatcatctctggtagactgcaagattgtctgaaaataaccatctcttagtgtgtaaagtcctgttcagaatctgcacagggtttttcagaggtgctgggttgataatgaaggcagcatccacagaacaaacatcatatttaaacaatgtatcttagtcctaaatttgaaggctaaaataaataagcagctatgatccgtaggataggaaattattatttttttctttttttgtagagacagggtctcgctatgttgcccagctggccttgaactcctagcctcaagtgattctctcgccttggcctcccaaagcactgggagaacagtcatgagccactgcacctggccaggaaattctttattccttgaaaatgtattatctgagtttaaattggctgtgaagtaggtaaatagaaaaatgcctaaaaatgtttttatttctaggagcttattgggctaggttatatgccctttataagctcaaaggggttaataagtaagaatttctatttttagtattaaaagtgtggcatgtactcacacaaaacagtgcatcctcttaagaaacttggcatggagatcagtgggccagattctcctacataaacattggttgaaattccttagagccaaaaaagaaa

SEQ ID NO: 183756 - DNA, 1915 bp, Homo sapiens
  Payload ID: 16202
  Gene Symbol: SLC30A10
  Gene Name: solute carrier family 30, member 10
  Uniprot ID: Q6XR72
  ENST ID: ENST00000366926
  CDS Start-End: 163-1620
ctcggcctcgcgttataaaaagcggtggggcagggccggcgagacaatctgggaggcgggtaccgggcctcacggatccgcgccgcgccccccacctgtggctgcgcgcggggtgggctgcgctcccctgggcggcgccgggcgcccggggctggtggcgagatgggccgctactctggcaagacgtgccggctgctcttcatgctggtgctcaccgtcgccttcttcgtggcggagctggtctccggctacctgggcaactccatcgcgctgctctccgactccttcaacatgctctccgacctgatctcgctgtgcgtgggcctgagcgccggctacatcgcccggcgccccacccggggcttcagcgccacctacggctacgcccgcgccgaggtggtgggcgcgctgagcaacgcggtcttcctcaccgcgctctgcttcaccatcttcgtggaggccgtgctgcgcctggcccggcccgagcgcatcgatgaccccgagctggtgctcatcgtcggcgtcctggggctgttggtcaacgtggtggggctgctcatcttccaggactgcgccgcctggttcgcgtgctgcctccggggacgcagtcgccgcctgcagcagcggcagcagctggcggagggctgtgtccccggcgctttcggggggcctcagggcgcggaggacccgcggcgcgcggcggacccgacagccccaggctcggactcggccgtaaccctccgggggacctcggtggaaaggaagcgggagaagggggcgaccgtgttcgcaaacgtagcaggtgattccttcaacacccagaatgagccagaagacatgatgaaaaaagagaaaaagtctgaagctctgaatatcagaggtgtacttttgcatgtgatgggagatgccctggggtccgtggttgtggtcatcacggccatcatattctatgtgcttcccctgaagagtgaggacccgtgtaactggcagtgttacattgaccccagcctgactgtcctcatggtcatcatcattttgtcatctgccttcccgcttatcaaggagaccgctgccattctgctacagatggtcccaaaaggagtcaacatggaagagctgatgagtaaactctctgctgtgcctggaattagcagtgtacatgaagtgcacatctgggaacttgtaagtggaaagattattgccaccctgcacatcaagtatcctaaggacaggggatatcaagatgccagcacaaaaattcgagaaatcttccaccatgcgggaatccacaatgtgaccatccagtttgaaaatgtggacttgaaggaacccctggagcagaaggacttactgttgctctgcaactcaccctgcatctccaagggctgtgctaagcagctgtgttgtccccccggggcactgcctctggctcacgtcaatggctgtgctgagcacaatggtgggccctctctagacacatacggaagtgatggcctcagtagaagagacgcaagagaagtggctattgaagtgtctttggatagctgtctgagtgaccacggacaaagtcttaacaaaactcaggaggaccaatgttatgtcaacagaacgcatttttaatctggtactcacataatcagaccatatagacgaggcactttggaaccacaagcttggctcacaaaaagagctttctgggttgtaggcccagactagacttgcagcatgcatgctctgtgttcactaggggttggctgtttgggattttagttaaacgtgtctgtgaatttttatgtaactaactcctttccattcccctgggtgtctcatgctgctctttgactgtttcagcttgaacatgcattttctaaagcaaactgcactagtgtatatatcagggacattaaagtctggg

SEQ ID NO: 183757 - DNA, 4744 bp, Homo sapiens
  Payload ID: 16203
  Gene Symbol: SLC31A1
  Gene Name: solute carrier family 31 (copper transporter), member 1
  Uniprot ID: O15431
  ENST ID: ENST00000374212
  CDS Start-End: 153-725
gcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagcatgaacttgccaatcaaaaaatgacaatcaatttgagaaaatagaaatagatatttttaaataaaaccattcacagtttactttgtcttgataccttggtttgtcccagctgaagtgaagcaagagagtttgaattaatttttccattataatgttttcgcatgtctgcctctaaaactgtgattttcaagctttagcgtgcatcagaatcacctgtagggcttgttaaaacactaattgctgggcctcaacccaaaagcccccaaagtggcacttctgagttcctgctgatgttacaagggaccacacttttgagaatctgtgctttaagctaaggaaatattgcctggtgggttggctgcctggtattgggcatggaaatttgaattgctgattggtagatggtgtgtctggacttaactcacgtagtaaatactgctgatcaatacctaatcattccacatttattgagctccacctgtgtgtatgtgtacccaagcacacatgtgtgaagggctatagccaaagtatttttactagcctgtatgaaatcactagtccttatttttaaaggtctatggtttcttggaagtagtttgattgttgagagagacctttgatctgcagtgtaaatctaccagtcatgggccagaagggcaaaagcccagctttctctttggaaagactcaggctgtggtttgttgatggccaggttttcctcaggctccaacaactgtgcttataccaagcagatcctcatcctccatataatcatctttgttattcgtgggggtttaattacattacaagtggccaaaacccctgttctcagtgaagaaccacattggatttgtattctgttcagttgtagtctacactgcagtcttattcctggttcaaactacctctttaaattgatttgtcttgtgctggtctgttaaatcctgccctccttggtgctagatccagttgtgcctcagggcagaggaaacaaaacacagctatcctgttggcctgtgttgtggttttgaagtttgtactttctctgtgggtgccagttaaatattggagagcaaggaatgtggacttgtatggctttgaaccaagagagggttatgagcctactggattgaggttaaaatccaagaaccaacatttagagctttgtgcttttctctcattccatcactttgtaatgatgatacttaacatgagcagggtgaatgacaggtactgacgaagtccaacacaaaggtataatacagcctgttgtctaaagccaaggagtcataaaaccatgagaaataaataggaatcaatagttagtagtgacattggtgctctctagaaatctcagcatgagctgctatagaataccctcccagcaacaaaacctaatcagtaaggccagctagacccaatggctcatgcctgtaatcccaacactttgggaggccaaggtgggaggatggcttgtgtccagaagttcgagaccagcctggacaacatagtgagatcctatctctataaaaaatcaaaaattagccaggcatggtggtgcatacctatagtcctggctatttgggaggctgaggcaggaggattgctttagccctggaggtcgaggctgcagtaagccatgattgcgccactgcactcagcccgggtgacaaagcaagaccctgtctcagaaaaaaagaaaattcaaggccagttaagacaaaatgctatgactttgaaattcacagaaagaaataacagtttagattaggtcttcaggtattcaggatagagataatctcctgaaaaacctgaatttcagagattcttagactggctgccaaaggatgaagctagtgaaggagaaaaagcttaaattccatcttgagctcttggattgtgataatacaatgatttcattaacttttcatttctgtatacctgttcatttggaatttaatgcttgacttctttgttcattttggatctaaacttctcttttcttccttccccattcacatctattagaagactgcatcaccatttctttggcccccttactctgttgtcctttcccttttctttcagtttttttaatcgcatgtctagtatattaagtctccatagccctcctgatgcagtagacagtgctatgctgtggatataataccaaccagaaattggcatttataaacctgttaagagactttaagcatgcttcaagaggcagttgacccactggaatttctataaggctggtacccttcccagagttacagaatcttaggtgccgtctctagtctgtgagggaggaactcccagcatccccattgcccacaaatggaatcctcactgtatccactaggagattagaaattaaggtttcttcactacttctatggtagggttgtctgaaattccctttcaggctgtgggtactggtcttgggttctagtcataaggggttccttataaggagcaggcggaggggagtacactttcatgtgatttaattttgatcctgccctctccagctgctccttcaaaagatacatcaaaagatagaaactctgggctgggcacagtggctcacacactttgggaggccaagcgggggtgcagatcacctgaggtcaggagtttgagaccagcctggccaatgtggtgaaaccccatctctactaaaaatacaaaaattagctgggcgtggtggtgcatgcctgtaatcccagctactcgggaggctgaggcaggagaatcgcttgaacccaggaggcggaggttgcagtgagccaagatggcgccattgcactccagcctgggcgacaagagcaaaactccgtctcaaaaaaaaaaaaaagatacaaagtctgcatttgatataatgccttaattactgggtctacaattaatgttgactgttttagattgtaagctcctggagagcagtattgctgtagtaggaatgttttaacagtgtcatatgaaaaagaacaaaataaatattttgattttgtgattcta

SEQ ID NO: 183758 - DNA, 1785 bp, Homo sapiens
  Payload ID: 16204
  Gene Symbol: SLC31A2
  Gene Name: solute carrier family 31 (copper transporter), member 2
  Uniprot ID: O15432
  ENST ID: ENST00000259392
  CDS Start-End: 134-565
ctcgcccggaccacgtgatccgtgcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaata

SEQ ID NO: 183759 - DNA, 1750 bp, Homo sapiens
  Payload ID: 16204
  Gene Symbol: SLC31A2
  Gene Name: solute carrier family 31 (copper transporter), member 2
  ENST ID: ENST00000374220
  CDS Start-End: 46-267
ccgagcgagcagacgcggccctggcgcccgccctgcgcactcaccatggcgatgcatttcatcttctcagatacagcggtgcttctgtttgatttctggagtgtccacagtcctgctgggcaagaaactaaagcccagagacaggaagagagactcgtgcagggtcacacagcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacgtagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatgggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaacaaatacattttagtaaatatatatttttaaata

SEQ ID NO: 183760 - DNA, 2574 bp, Homo sapiens
  Payload ID: 16205
  Gene Symbol: SLC32A1
  Gene Name: solute carrier family 32 (GABA vesicular transporter), member 1
  Uniprot ID: Q9H598
  ENST ID: ENST00000217420
  CDS Start-End: 264-1841
gctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggct

SEQ ID NO: 183761 - DNA, 2404 bp, Homo sapiens
  Payload ID: 16206
  Gene Symbol: SLC33A1
  Gene Name: solute carrier family 33 (acetyl-CoA transporter), member 1
  Uniprot ID: O00400
  ENST ID: ENST00000359479
  CDS Start-End: 433-2082
atatgctttttctggagtcctgtagagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaa

SEQ ID NO: 183762 - DNA, 9217 bp, Homo sapiens
  Payload ID: 16206
  Gene Symbol: SLC33A1
  Gene Name: solute carrier family 33 (acetyl-CoA transporter), member 1
  Uniprot ID: O00400
  ENST ID: ENST00000392845
  CDS Start-End: 382-2031
gcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccacttaactcttacatatgaaatgtgttttgatttttaatttttggattaagaaactcagattgccataataaccttttatttcttcccgtgtatattattacaaattatatatactttcaaacatagttttttttttttttaattgagacagagtctcactttgtcacccaggctggagtacagtggtgcaatctcggctcactgcaacctctgcctcctgggttcaagtgattctcctgccccagtcctctgagtagctgggactacaggcgcacaccaccacacccggctaatttttgtatttttagtagagatggggtttcaccatgttggccaggctggtcttgaactcctgacctcaagtgatccacccgcctcggcctcccaaagtgctgggattacaggcatgagccactgcgcccagccttcaaacatagttttaatgtcagtacatctttaatgacttgaagttttaaaacattttaagcctttaaggtgaaagccatttaattaatttgctctagaaataagcacaaaaaattatagttaatttgaatacatgtatgtaatgcatgtcaaaataacttgttaatagctatgtgcaactgtgttgcatacattgatcactaatggcatttaaaaatgatctgcctaaatctgaggatctgtttattataaatcagtagtactaaaatataccaccctgtttttatgttgtgggtgtttttcttgattgattgatcctgataaattaaacagtaccttcaagtatggacttttaactcctccagttaatgcatcatatgtttactggctaatattagattgaacatttttctctctatgtcagtatctccatatgcacattggttgccgcatatatacatctgagtttgaaaagttcttctgagattacctaaaagtaacaccacagattccttccattgtaaatactttattttattttattattattttttagagacatggtctcacttttgcccaagctggagtacagtgatgcaatcatagctcactgcagcctcaaattcctaggctcaagggatcttccttaggctggatgctgtggctcacacctgtaatcacaacactttaggaggccaaggcaggaggatcacttgaggtcaagagttcaagaccaacctggtcaatataataagaacctgtctttatgacttcttttttttttttaattatccaggcatggtggtacacaccagtagtcccagctacttgggaagcttaggcgggagggttacttgaacccaggaggtcaaggcttcagtaagcagtgattgtggtactacattcctgtctgggtgacagagtgagaccctgtctcaacaacaaaaaaggatctttccacctcagcctctctggtagctaggactacaggcacacagcactatgcccagctaataaaaaataataattttttatagaggtggggtccgctatattttccaggctagtcccaatctcatagcttcaagcagtcgtccagccttgacctctcaaaatgctgggattacaggtgtaagccaccgtgccctgcccatgataaatattttaattttgcctgataagtcataaaaagtttattcaacaccttaaatagatttctcaattttttaaaaatattaaacctttgaaatcgaaagtaatttttggatttcacccctttattgcaaggtttttgatgtctgtgggaaaaacccctgaattgcttgtgaaactctggatatgtaattttttttctttttctgaacagagtaaaatcttggatgggccatgatccaaaaatcatggttttgaaagtagaccgtactataagccataatcacaaatctgaggtaatagttgtgaaagtgtttaaaacatcctgaaaacaatgttgaaaaaaaaaatctatgataaaaactataaaatctctgcatatgttatactgtattgaacttgaaactttgaaggaattagagtagataagacattaatggtagaagagaaaccacaggggtgaattatatcctacaaaagagaaatcttcatgatttaaccttttttttctgagtgacttttattttgccttattaacagaaacctgagaaagtatgttgctttgtattaaatggttgagaccattatttgatataaaagctgaaaatttaatttttgtattttggagaattctgtggttccaagtaattgaaagaatgactaaagctgtatgtcatagaccctgctaaaatgaaataacttgttgggaacattccatgcagatttccaaaatgtattttaccttattattagagaaagaaaataaacttttaaaataatctgataactagcattcatatatttaataagtattttggttacagaagggaaggtgatactgtacattgtaactgctgagacttttttttaaccaatgtctttggtagatagcgaggcacaattattttctcttagggaggattttgaatacctattgcaggctgggcatggtggctcacgcctgtaatcccaaccctttgggaggccgaggtgggtggatcacttgaggtcaggagtttgagaccagcctggccaacatggtgaaacgccgtctctactaaaaatacaaaaattagccaggcatagggtggcacacgactgtaatcccagctactagggaggctgaggcaggagaattgcttgagcccgggaggcggagcttgcagtgagttgagattgcgccactacacttcagcctgggcgacagagcgagactccgtttcaaaaacaaacaaacaaaaacaaaacaaaaacacctactgcagaccatgttctttttactttattttattttattatttttttgagatggagtctggctctgttgcccaagctgctcactgcaacctccgcctcccgggttcaagcgattctcctgcctcagccttccaagtagctgggactacagatgtgcactactacgcccagcttatttttgtatttttggtcgagatggggttttgccatgttggccaggctgatctcaaactcctgaccttaggtgatcttcccgccttggcctcctaaagtgctgggattacaggcgtgagccaccgctgctggctctttttactttagattgtatctgcctgatttgacaatgccaaattttttatgtaatcaccatttggtttgggactgagagctctttcattttctaccagtcaaaccactattagagtcttcatgttacttccccaatttgctagcaaggtagaatcagcatggatagcttattttccttattggaattctgttttggaagaggcaggtcttatagcagggcagactaattaatgtgctgaactcattccctcctgcttaagtgaataaaaacttttatttgactatggattataaagattgcctttaaggagccttgtttattttggggaaggagaatggatattttgtaggagaaaaagactttatatagtaaatgaaaagtctatgggctgggtgtagtggctcatacctttaatcccaacactttgggatgccaaggtaggagtattgcttgagctcaggagatcgagaccagggagactgcatctctatttttaattaaaaaggaaagaaaaagaaagaaagttctatgactaatcacctttactctaaaaaaattttgcccaaatgtgtaatgaaagagatcatatttaaatatcagcaatattaatttgcatagctcataagaagtcttgactcatttagaaaaaggttgctacagtttaatagttttttattgtcaatatagacaatataactttataacaattttatgtgaagaataatgattaaatggcatgactgaaatgcacaaggtacaggtacaatccttagggagttatcttaaatttctttttttttttttttttgagatggagtcttgctctgtcgcccaggctggagtgcagtggcatgactccctgcaccctctgcctgctgggttcaagtgattctccttcctcagcctctccattagctgggattacaggtgccttccaccacacctggctaatttttttgtatagtatagacggggtttcaccatgttggtcaggctggtctcaaactcctgacctcgtgatctgcctgcctcggcctcccaaagtgctgggattgcaggtgtgagccactgcacctggcgggaattatcttaaatttctaaaattgaataccccagtcagctacaattaatcaatcactaatgtaaatattaaagcctattcttattttccttgaaatgatcttaaatgttggaaaagtttaattttgtagtcagagttagtgaaattgaaatttttttatcacctgcccctataaaattagagaaatataagattggaaaaaaatttgatatttaagaaagtggcatatttgaaccaggtgtgttggcttacacctgtagtcccattagtttgggaggcttaggcaggagaatcacttgaggtcaggagtttgagaccagcctggccaacatggtgaaaccctgtctctactgcaaatacagaaattagccgggcatggtggtgggcacctgtaatcccagctacttgggaggctgaggcaggagaatcggttgaacctgagagagggatgttgcagtgagccgagattgtgctactattctccagcctgggcaatagagtgagactcagtctcaattaaaaaaaaaaaaaaaaaatgcggccgggtccagtggctcacgtctgtaatcccagcactttgggaggccaaggcaggcagatcacttgaggtcaggagttgaagaccggcctgacccacatggagaaaccccatctctactaaaaatacaaaattagccgggtgtggtggcccaggtctgtaatcccatctactcgggaggctgaggcaggagaatcgcttgaacccgggaggcaggggttgcggtgagccgagatcgcaccatcgcactccagcctgggtgcaagagcgaaactctgtctcaaaaaaaaaaaggaagtggcatatttggtaaattgataaattaccactgtcaaattatattggtgagtctatatctattgttgtccccagatgttgcctttgcaagaattagtgtaaaattggaaaaaatactcaatgttgaaagctgtcattgttgagatctttatgaaattattgtgcccatgtccaagtttgaattagagatacacagcacacaatcatttctgttaccacttttggaatatctagcattagccttgatagttttgtgtggtgtgttttgagtatatctgaactgttagttatatttggttaatttattaaaagatgtgtgttaaaccttaatatttatgcagtgtttaagtatttggaatatatttgaaataaattatccagtgttttagataaatggttatttaattgcttaaagtgattctctaaaaaataaaacattaatgaaa

SEQ ID NO: 183763 - DNA, 764 bp, Homo sapiens
  Payload ID: 16206
  Gene Symbol: SLC33A1
  Gene Name: solute carrier family 33 (acetyl-CoA transporter), member 1
  ENST ID: ENST00000468581
  CDS Start-End: 1-328
gggcaatgttttgtttttggcccttgaatctgccgacttttgtaacaaatatttgcggtttcagcctcaacccagaggaatcgttactctttcagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaa

SEQ ID NO: 183764 - DNA, 1060 bp, Homo sapiens
  Payload ID: 16206
  Gene Symbol: SLC33A1
  Gene Name: solute carrier family 33 (acetyl-CoA transporter), member 1
  ENST ID: ENST00000475842
  CDS Start-End: 1-808
cgatgacagaacacccgacgtgattgctctcactgtggcgttctttttgtttgaattcttggccgccactcaggacattgccgtcgatggttgggcgttaactatgttatccagggaaaatattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacagattattgcttgggttagaatatgccctactggtttggtggactcctaaagtagaacatcaagggggattccctatatattactatatcgtagtcctgctgagttatgctttacatcaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttga

SEQ ID NO: 183765 - DNA, 555 bp, Homo sapiens
  Payload ID: 16206
  Gene Symbol: SLC33A1
  Gene Name: solute carrier family 33 (acetyl-CoA transporter), member 1
  ENST ID: ENST00000496772
  CDS Start-End: 1-555
tggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaat

SEQ ID NO: 183766 - DNA, 2573 bp, Homo sapiens
  Payload ID: 16207
  Gene Symbol: SLC34A1
  Gene Name: solute carrier family 34 (type II sodium/phosphate cotransporter), member 1
  Uniprot ID: Q06495
  ENST ID: ENST00000324417
  CDS Start-End: 92-2011
cttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacaggctcccacctccatgtccagagcagaggccaactccagccagacccttggaaatgccaccatggagaaatgcaaccacatctttgtggacactggcctaccggacctggctgtggggctcatcctgctggcaggatccctggtgctgctgtgcacctgcctcatcctcctagtcaagatgctcaactccctgctcaagggccaagtggccaaggtcatccagaaggtcatcaatacggacttccctgcccccttcacctgggtcacaggctactttgccatggtggtgggcgccagcatgaccttcgtggtccagagcagttctgtgttcacctcggccatcaccccactcatcggtcttggtgtgatcagcattgagagggcctacccgctcacactgggttccaacatcggcaccaccaccacggccatcctggctgccctggccagccccagggagaagctgtccagcgctttccagattgccctctgtcacttcttcttcaacatctcgggtatccttctgtggtacccggtgccctgcacacgcctgcccatccgcatggccaaggcgctggggaaacgcacggccaagtaccgctggtttgccgtcctctatctccttgtctgcttcctgctgctgccctcactggtgtttggcatctccatggcaggctggcaggtcatggtaggtgtgggcacgcccttcggggccctgctggccttcgtggtgctcatcaatgtcctgcagagtcggagtcccgggcacctgcccaagtggttacagacatgggacttcctgcctcgctggatgcactccctgaagcccctggaccacctcatcacccgcgccaccctatgctgtgccaggcctgagccccgctcacccccgctgccccccagggtcttcctggaggagctaccccctgccacaccctccccccgtcttgcactgcctgctcaccacaatgccacccgcctctaggctgtgggcccagactacagcctggaatggggaaggcctggggtggaaaggcaggggagggagggtgtgtgtaggtatgtgcatgtgcctgtgccaccctgggtgccagtctctccttctgtagctccgcaaagctctgggcttgtgtgagagtgtcggtgtgtgtgcatgtgtgggggtgagtctgcatgtgcacctgtcatgtgtagaagcttgtatttgtgtacaggtgtgccagcccatgcaggtgtacacagacacacctgtgggaggctgtgtgcaggctgcaggatatctgggtatgatttcaggtcctctgcacgtgtacacatgactaggataggcaggagtaagggtgggtctgggtatatgactgtgcagctgtttgtgcatagatgttggtgcctgcgttactgaatttgcacacctccttgccaccttccttcctccaagataccatctcctcatcctaacccaggtcttcggcaccaccacaattaattcccttcccaacacttgcctgatggaaaaaaaacaaaggaattaaaactctcctcaggca

SEQ ID NO: 183767 - DNA, 1912 bp, Homo sapiens
  Payload ID: 16207
  Gene Symbol: SLC34A1
  Gene Name: solute carrier family 34 (type II sodium/phosphate cotransporter), member 1
  Uniprot ID: Q06495
  ENST ID: ENST00000512593
  CDS Start-End: 102-1124
gtcctggaggcttcattgagctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacagcaaaatctggaagggagagaaatcacacactttgatcttcgcaaaaagcaagccatggaagacagctctgttcctcactgcccctgagctccctgccggccacctactgcagcttccggcagatctcaaccagcagcctccacgtcctcacttgaagtcatcctcacccaggttcactctggggaggccgcccttgggcctttctctacggctgcagctgacacttgtccagctggtttctcttcctcactctaccaggaaatgctttccttaaacgctttctgcagggcagggtctcatttcctcggcttggagagtagctggtgggtgggacccaagctctcactttcatcccctttctgggacagcgccccgaaggagtgtgactcacacagcagtggatgtgcttggtcttgcaaagtgtgaagtgcgtcctggctcttcctgcccaaagacgggccacagagtctccccgtgctcccttccaacctgttcccattgacgccaactttcaccatgctggacctgaaccagcccgaaacagtctccagggaagctatgcaccagggagaggaggcaagtccaaggcctaccagatggggaaagcagcagcagcggcagttgagtgatcagacacttgagtctcccgggaccctgacaccgtcctgggaatcaccttcttatgtggccacactgtggactgtcaactatacctgcctggattaaacaagcatcttttgaggacttgcaacctgggaggcagggattatcacgtccccattttacagacgaggagcactgagccccagagaagtgcagtggcttgcccaagtccatgtaattgaggtaggatacaaatcctggtagaatcctga

SEQ ID NO: 183768 - DNA, 532 bp, Homo sapiens
  Payload ID: 16207
  Gene Symbol: SLC34A1
  Gene Name: solute carrier family 34 (type II sodium/phosphate cotransporter), member 1
  ENST ID: ENST00000504577
  CDS Start-End: 204-532
atctggaaaatagaacttggaagagacgatgtttcagggccttgcctgctctgtgctggggccaggcagctctgttgaagtccaggctctccaagagaggacaaagtcaaggaggccaggaaagccattgctttgttacccaaagggaacccaccgcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcacctt

SEQ ID NO: 183769 - DNA, 4122 bp, Homo sapiens
  Payload ID: 16208
  Gene Symbol: SLC34A2
  Gene Name: solute carrier family 34 (type II sodium/phosphate cotransporter), member 2
  Uniprot ID: O95436
  ENST ID: ENST00000382051
  CDS Start-End: 51-2123
tccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaa

SEQ ID NO: 183770 - DNA, 2174 bp, Homo sapiens
  Payload ID: 16208
  Gene Symbol: SLC34A2
  Gene Name: solute carrier family 34 (type II sodium/phosphate cotransporter), member 2
  Uniprot ID: O95436
  ENST ID: ENST00000503434
  CDS Start-End: 105-2174
agtttgtttctattagggcccgtggccatcagcgaagggtccgtccttcagccgtcttggggagcaaagcccgcaatttatgttttccaagccacaaatggaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtag

SEQ ID NO: 183771 - DNA, 549 bp, Homo sapiens
  Payload ID: 16208
  Gene Symbol: SLC34A2
  Gene Name: solute carrier family 34 (type II sodium/phosphate cotransporter), member 2
  ENST ID: ENST00000513204
  CDS Start-End: 61-549
attgcggacctagagcccagactcccagggcagaaagcgccccacagactgataaagaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacg

SEQ ID NO: 183772 - DNA, 582 bp, Homo sapiens
  Payload ID: 16208
  Gene Symbol: SLC34A2
  Gene Name: solute carrier family 34 (type II sodium/phosphate cotransporter), member 2
  ENST ID: ENST00000507530
  CDS Start-End: 100-582
gtttctattagggcccgtggccatcagcgaagggtccgtccttcagccgtcttggggagcaaagcccgcaatttatgttttccaagccacaaatggaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagc

SEQ ID NO: 183773 - DNA, 2162 bp, Homo sapiens
  Payload ID: 16208
  Gene Symbol: SLC34A2
  Gene Name: solute carrier family 34 (type II sodium/phosphate cotransporter), member 2
  Uniprot ID: O95436
  ENST ID: ENST00000504570
  CDS Start-End: 73-2142
atatatacccggggcgctgcgctccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaaataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtgactgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcag

SEQ ID NO: 183774 - DNA, 2124 bp, Homo sapiens
  Payload ID: 16209
  Gene Symbol: SLC34A3
  Gene Name: solute carrier family 34 (type II sodium/phosphate cotransporter), member 3
  Uniprot ID: Q8N130
  ENST ID: ENST00000361134
  CDS Start-End: 187-1986
acacaggtaggagctcctaggaccaggctgaggcccagggacagtgaggccgaggctgggtggcctccaggccaagggcttgggccccatcctgagtctccaggacccaagggcaagagacgccaggcttgggcagcaggagggaggatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctgtgctgcgcggccgcgtggcccaggtcgtgaggacagtcatcaatgcggacttccccttcccgctgggctggctcggcggctacctggccgtcctcgcgggcgccggcctgaccttcgcactgcagagcagcagcgtcttcacggcggccgtcgtgcccctcatgggggtcggggtgatcagtctggaccgggcgtaccccctcttactgggctccaacatcggcaccactaccacagccctgctggctgccctggccagccccgcagacaggatgctcagcgccctgcaggtcgccctcatccacttcttcttcaacctggccggcatcctgctgtggtacctggtgcctgcactgcggctgcccatcccgctggccaggcacttcggggtggtgaccgcccgttaccgctgggtggctggggtctacctgctgctcggattcctgctgctgcccctggcggccttcgggctctccctggcagggggcatggagctggccgctgtcgggggtcccctggtggggctggtgctcctcgtcatcctggttactgtcctgcagcggcgccggccggcctggctgcctgtccgcctgcgctcctgggcctggctccccgtctggctccattctctggagccctgggaccgcctggtgacccgctgctgcccctgcaacgtctgcagccccccgaaggccaccaccaaagaggcctactgctacgagaaccctgagatcttggcctcccagcagttgtgacgggcagttgctgagcagaccgccccaccctccccggctgggagggctctggagggccctggagggggggtccccgcggcagctgacctccggtcacctgcttccccttctgtgcaaataaaccaggctgttatctgg

SEQ ID NO: 183775 - DNA, 2162 bp, Homo sapiens
  Payload ID: 16209
  Gene Symbol: SLC34A3
  Gene Name: solute carrier family 34 (type II sodium/phosphate cotransporter), member 3
  Uniprot ID: Q8N130
  ENST ID: ENST00000538474
  CDS Start-End: 225-2024
atggagacaaggcctaggggccttggggccaggagggtacccccgtgagggcctgggctcctgggtaaacattaatgggctcagtacccagcaggtcatgtgcgcgatcaggggatctttgacctgcaactgctcccgccccgtgtctcctccctgcaggtgccccctcaccacccacacagcagatctagacctgggcctgggtctgtccctgcccgaaatccatgccgagttcccttcccggcagccaggtcccccaccccactctggacgcggttgacctagtggaaaagactctgaggaatgaagggacctccagttctgctccagtcttggaggaaggggacacagacccctggaccctccctcagctgaaggacacaagccagccctggaaagagctccgcgtggccggcaggctgcgccgcgtggccggcagcgtcctcaaggcctgcgggctcctcggcagcctgtacttcttcatctgctctctggacgtcctcagctccgccttccagctgctgggcagcaaagtggccggagacatcttcaaggacaacgtggtgctgtccaaccctgtggctggactggtcattggcgtgctggtcacagccctggtgcagagttccagcacgtcctcctccatcgtggtcagcatggtggctgctaagctgctgactgtccgggtgtctgtgcccatcatcatgggtgtcaacgtaggcacatccatcaccagcaccctggtctcaatggcgcagtcaggggaccgggatgaatttcagagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcagttggactccgacatgatcatgagcagtgccacaggcaacgccactaacagcagtctcattaagcactggtgcggcaccacggggcagccgacccaggagaacagcagctgtggcgccttcggcccgtgcacagagaagaacagcacagccccggcggacaggctgccctgccgccacctgtttgcgggcacggagctcacggacctggccgtgggctgcatcctgctggccggctccctgctggtgctctgcggctgcctggtcctcatagtcaagctgctcaactctgtgctgcgcggccgcgtggcccaggtcgtgaggacagtcatcaatgcggacttccccttcccgctgggctggctcggcggctacctggccgtcctcgcgggcgccggcctgaccttcgcactgcagagcagcagcgtcttcacggcggccgtcgtgcccctcatgggggtcggggtgatcagtctggaccgggcgtaccccctcttactgggctccaacatcggcaccactaccacagccctgctggctgccctggccagccccgcagacaggatgctcagcgccctgcaggtcgccctcatccacttcttcttcaacctggccggcatcctgctgtggtacctggtgcctgcactgcggctgcccatcccgctggccaggcacttcggggtggtgaccgcccgttaccgctgggtggctggggtctacctgctgctcggattcctgctgctgcccctggcggccttcgggctctccctggcagggggcatggagctggccgctgtcgggggtcccctggtggggctggtgctcctcgtcatcctggttactgtcctgcagcggcgccggccggcctggctgcctgtccgcctgcgctcctgggcctggctccccgtctggctccattctctggagccctgggaccgcctggtgacccgctgctgcccctgcaacgtctgcagccccccgaaggccaccaccaaagaggcctactgctacgagaaccctgagatcttggcctcccagcagttgtgacgggcagttgctgagcagaccgccccaccctccccggctgggagggctctggagggccctggagggggggtccccgcggcagctgacctccggtcacctgcttccccttctgtgcaaataaaccaggctgttatctgg

SEQ ID NO: 183776 - DNA, 1898 bp, Homo sapiens
  Payload ID: 16210
  Gene Symbol: SLC35B2
  Gene Name: solute carrier family 35 (adenosine 3'-phospho 5'-phosphosulfate transporter), member B2
  ENST ID: ENST00000393810
  CDS Start-End: 145-429
ggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtggacttgg

SEQ ID NO: 183777 - DNA, 2043 bp, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENST ID: ENST00000393812
  CDS Start-End: 145-1443
ggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgca

SEQ ID NO: 183778 - DNA, 1715 bp, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENST ID: ENST00000537814
  CDS Start-End: 212-1111
ggggcggagggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtgg

SEQ ID NO: 183779 - DNA, 1909 bp, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENST ID: ENST00000538577
  CDS Start-End: 286-1305
ggggcggagggggccgcggggagggaggcgggaagagcgcggcacttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtgg

SEQ ID NO: 183780 - DNA, 2014 bp, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENST ID: ENST00000615337
  CDS Start-End: 259-1410
agaattactacccagccaacaaagcaaggagacaccttcatcctgtcagaaaacggggaaactaacacagaggagcggcttgggatgcagagcctcaatgtcctgtccacaagatggcaatgatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtgg

SEQ ID NO: 183781 - DNA, 2063 bp, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENST ID: ENST00000619636
  CDS Start-End: 308-1459
acgtgactgccgcgcctcagcacgggggccgggtggggtcccggctgctcggccgtcggccagcatatcgctgcccggagccagcggggatgggagctgcggcttggttttgtgctccttggggagcttcgggcggaggggctggggaccctgacgtcccggatcgtggagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgcagtgg

SEQ ID NO: 183782 - DNA, 2137 bp, Homo sapiens
  Payload ID: 16211
  Gene Symbol: SLC35B3
  Gene Name: solute carrier family 35 (adenosine 3'-phospho 5'-phosphosulfate transporter), member B3
  Uniprot ID: Q9H1N7
  ENST ID: ENST00000379660
  CDS Start-End: 451-1656
gcggtggaaagtgcaggagtgggcgaggaggaggaggaagaggaggtgatggcgacggaccaggggagggggagatgctccgtctagctcagacgccacgcaggctgccgtcacccttccgggtgacataccggccttggggtacgcgtgccttcggggcctttcctgtgtttgggacccagatctcctctcctccagaaaaccttgacactgcccatcttcctcatccagaaggagcgttcgaggaatggatgaggtcgggatggaagaaacgggtgattcccttttttgaaagagcggaaaccggccgggcggtttccagggaggagcatctgttcctcctcgcccgtttttcgccctcgggctggcgagaactccctcaggtcccaatccgtggactcgcaggggccatgattgattccggagcgcagttaatcaaggcataatggcatggacttgacacagcaagcaaaagacatacagaacataacagtccaggaaaccaacaaaaataactctgaaagcattgaatgcagcaaaataacaatggatctcaagttcaacaattccaggaaatatatttctatcactgtgccatccaaaacccaaacaatgtcaccacacatcaagtcagttgacgacgttgtggtacttggcatgaatctcagcaagtttaacaaacttactcagtttttcatatgtgttgctggagtttttgtattttacctaatttatgggtatttacaggaattaatattttcagtggagggttttaagtcctgtggctggtaccttaccttagtgcagtttgccttttactccatatttggcctaatagaacttcagcttattcaggacaaaaggaggagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggaaagcgttataatgttgcagatgtgtctgctgccatatgtatgagccttggcctgatatggtttaccctcgctgacagcacaactgcaccaaatttcaacctgacgggtgtggtgcttatttccctggcactatgtgcagatgccgtcattggaaatgttcaagagaaagctatgaaacttcataatgcttctaattctgaaatggtattgtattcgtattcaattggttttgtatacattttactgggattgacatgcactagtggattaggccctgcagtaacattttgtgcaaagaatccagttcggacctatggttatgcgttccttttttccctcactggatattttggaatctcctttgttctggctttgattaaaatttttggtgcacttattgctgtaacagtgacaacaggaagaaaagcaatgaccattgtactttcgtttatattctttgctaaaccattcacgtttcagtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaa

SEQ ID NO: 183783 - DNA, 1851 bp, Homo sapiens
  Payload ID: 16212
  Gene Symbol: SLC35A1
  Gene Name: solute carrier family 35 (CMP-sialic acid transporter), member A1
  Uniprot ID: P78382
  ENST ID: ENST00000369552
  CDS Start-End: 28-1041
agttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaagaaa

SEQ ID NO: 183784 - DNA, 1720 bp, Homo sapiens
  Payload ID: 16212
  Gene Symbol: SLC35A1
  Gene Name: solute carrier family 35 (CMP-sialic acid transporter), member A1
  Uniprot ID: P78382
  ENST ID: ENST00000369556
  CDS Start-End: 80-916
acaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcagttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgt

SEQ ID NO: 183785 - DNA, 1653 bp, Homo sapiens
  Payload ID: 16212
  Gene Symbol: SLC35A1
  Gene Name: solute carrier family 35 (CMP-sialic acid transporter), member A1
  ENST ID: ENST00000369557
  CDS Start-End: 80-649
acaaggggcggtccccggtgtcctgcgcgggggcgcggagggggcgggcgtcagttccgcggggggctgtcggggaaccatggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtgttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtaaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgtgtaacttctcaaaatgaatctatttcataactcggacaatttctgggtggtgactgagtacccctttagtgagtacccctttagtgctatatttgtgccattcattatctggttcatatttcttttctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgt

SEQ ID NO: 183786 - DNA, 724 bp, Homo sapiens
  Payload ID: 16212
  Gene Symbol: SLC35A1
  Gene Name: solute carrier family 35 (CMP-sialic acid transporter), member A1
  ENST ID: ENST00000544441
  CDS Start-End: 1-198
atggctgccccgagagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtggaacaaaatccattattagggtttggcgctatagctattgctgtattgtgctcaggatttgcaggagtatattttgaaaaagttttaaagagttcagatacttctctttggttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtga

SEQ ID NO: 183787 - DNA, 1206 bp, Homo sapiens
  Payload ID: 16212
  Gene Symbol: SLC35A1
  Gene Name: solute carrier family 35 (CMP-sialic acid transporter), member A1
  ENST ID: ENST00000622775
  CDS Start-End: 42-611
acaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaaagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggagtatattttgaaaaagtttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctttcttgcaagtgttggtggcctctacacttctgttgtggttaagtacacagacaacatcatgaaaggcttttctgcagcagcggccattgtcctttccaccattgcttcagtaatgctgtttggattacagataacactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaacgaagctatctgagtgaactgctaatacagaaacttaatgtagacctgtttggggtctactattgttttagaatgaaggaattgtattattgtgtgtatatataatttgtaaataaaaagtatggagatg

SEQ ID NO: 183788 - DNA, 4171 bp, Homo sapiens
  Payload ID: 16213
  Gene Symbol: SLC35C1
  Gene Name: solute carrier family 35 (GDP-fucose transporter), member C1
  Uniprot ID: Q96A29
  ENST ID: ENST00000314134
  CDS Start-End: 1397-2491
agtgcaccggaggaggtgagcgccaggtcgccttcgcggcccggggacacaggcagggacgcgggagctgatgcggctggaccggccggggaaacagtattttctggaaggggtaagagatgctgtcttgagcctttggaatctcggatccgggccgcccagaggacctcgacaggagcacagggaggacaaactgaagtccgagagaggcggcgtggcctccggcctcggggagcgctgccgggggtctcgggcttgggagagggcctgggggcggtgaaaatggggggaaaggaggggaccacaacattgttatggaagagtgagctcggattggcagagggacgcggggctgcaacgcgagtctccggaggtggaggggtccaggctgatgtagcgccgcccgggtcctgggtcggggttccgggaagtggacctgcgagccaagcctagccaagtcgggggacggaggctccggggcggacggagctgagggtgggcaggcgaggttgatggagcccttccaggaagcagggcgaggctcaagcacccagaaaaacctgtggctgccgaggtcccccgccagcagcgggcagcggagcgcaggggcggggctggggactggcgaactccgcctctctggggctgtcgctttaagggcaaggcggggcgtgcgggccctttaaggccacgtgggggcgtgtcaggaagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataag

SEQ ID NO: 183789 - DNA, 1756 bp, Homo sapiens
  Payload ID: 16213
  Gene Symbol: SLC35C1
  Gene Name: solute carrier family 35 (GDP-fucose transporter), member C1
  Uniprot ID: Q96A29
  ENST ID: ENST00000442528
  CDS Start-End: 478-1533
tccccgcacgcacttctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgcc

SEQ ID NO: 183790 - DNA, 582 bp, Homo sapiens
  Payload ID: 16213
  Gene Symbol: SLC35C1
  Gene Name: solute carrier family 35 (GDP-fucose transporter), member C1
  ENST ID: ENST00000526817
  CDS Start-End: 367-582
tctggaagtgcaagccggtagcgcggcgggccagggatacagccaagtcccgggacgtgccagctgcggtaactgaagccgggtcccgggcgggcgggggtaccagggacaggagtagccttggaaagaggagagggcctcctcccacgaccgtccggatcaccgcctctccgccggcacccccggggcccatgccgcgaacaggccggcgaggctggcaaggtgcccgggcccggggcggaaagcaggaagtcgatcccgcgggcgcggcccagggtgcggcgctgcagatgcagcacggggtcgcggggcgggcgcccagtgcaccggaggagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacg

SEQ ID NO: 183791 - DNA, 695 bp, Homo sapiens
  Payload ID: 16213
  Gene Symbol: SLC35C1
  Gene Name: solute carrier family 35 (GDP-fucose transporter), member C1
  ENST ID: ENST00000530471
  CDS Start-End: 200-695
ctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcg

SEQ ID NO: 183792 - DNA, 2447 bp, Homo sapiens
  Payload ID: 16214
  Gene Symbol: SLC35C2
  Gene Name: solute carrier family 35 (GDP-fucose transporter), member C2
  Uniprot ID: Q9NQQ7
  ENST ID: ENST00000243896
  CDS Start-End: 484-1581
gagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 183793 - DNA, 2175 bp, Homo sapiens
  Payload ID: 16214
  Gene Symbol: SLC35C2
  Gene Name: solute carrier family 35 (GDP-fucose transporter), member C2
  Uniprot ID: Q9NQQ7
  ENST ID: ENST00000317734
  CDS Start-End: 127-1311
aagttaccgcccgtgccgcggttcggcggcggcatccggcctcgcacttccggtggggagattccggcctggagctcccagggccgagcagaccttgggacctgtgagcgctgcatccaattaaccatgggaagggtcagcaccagccaccagccccttagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttctttt

SEQ ID NO: 183794 - DNA, 2505 bp, Homo sapiens
  Payload ID: 16214
  Gene Symbol: SLC35C2
  Gene Name: solute carrier family 35 (GDP-fucose transporter), member C2
  Uniprot ID: Q9NQQ7
  ENST ID: ENST00000372227
  CDS Start-End: 542-1639
gaaaagcagaagaaaaaccaggagaatgtggtatcgtggcacccaagagaaggttttttctaggaggaggaagtgatccattgtgtaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 183795 - DNA, 2246 bp, Homo sapiens
  Payload ID: 16214
  Gene Symbol: SLC35C2
  Gene Name: solute carrier family 35 (GDP-fucose transporter), member C2
  Uniprot ID: Q9NQQ7
  ENST ID: ENST00000372230
  CDS Start-End: 283-1380
ccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 183796 - DNA, 588 bp, Homo sapiens
  Payload ID: 16214
  Gene Symbol: SLC35C2
  Gene Name: solute carrier family 35 (GDP-fucose transporter), member C2
  ENST ID: ENST00000420518
  CDS Start-End: 1-588
atggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgcttccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcggg

SEQ ID NO: 183797 - DNA, 731 bp, Homo sapiens
  Payload ID: 16214
  Gene Symbol: SLC35C2
  Gene Name: solute carrier family 35 (GDP-fucose transporter), member C2
  ENST ID: ENST00000424568
  CDS Start-End: 259-731
gcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctcgcgcggcactggtcctggtggtcctcctcatcgccgggggtctcttcatgttcacctacaagtccacacagttcaacgtggagggcttcgccttggtgctgggggcctcgttcatcggtggcattcgctggaccctc

SEQ ID NO: 183798 - DNA, 5740 bp, Homo sapiens
  Payload ID: 16214
  Gene Symbol: SLC35C2
  Gene Name: solute carrier family 35 (GDP-fucose transporter), member C2
  Uniprot ID: Q9NQQ7
  ENST ID: ENST00000543605
  CDS Start-End: 292-1326
ggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaatccttttaacaactaagagactaaagcctggaaaagataaagagctgcttaagtggccgggctgaggttcacatccaagtctgtgtacgtctgtgtgtgcacgtgctgcacgtgacatccacacagcctcctggaacttcatgggcccctggggcttgggctttccactcctccttggccaagtcccacgtcttctctagactgcaggcctctctcaaatgaggaagggagggggcaagaccccagctctgatgtgctgtggactgagtctactcctgtaaactggttcccgggccatgggagacccccccggcccttggggacaaagctttccaggcgaagtgctcctaggcactcacagcaggtggcgccattgcaccacactggctcccagagcccagctgccctgccacggctatccagacaccggcagaaaaggggtgcttggaagaggacagtgggtatccatgggtggggacaaggatagggcttgttctaaaattgtttccatcaggttggagtcactaaagctcgttcggttaagcccaggagaactttaatactttaaaaatgggtctgcaaacttcctgtaaagggccagatagtaaatatttggggtttggggaccatatggcgtctgttgcagctactctgccatcgtagcacaaaagcagccatagatgacacagacccagggtgtggctgtcccagtgaaaccccatttacaaaagtaggatccagcttgctggctgaagtttaccagcaggagaaccctcaagaattctcgagtccaacttccacttctgcagcaggagactgaagccaggagggggcggtgactagcccgaggccctcagagcctccgtgctcaggagtcagaccgagatctgcctctaattcagattcccagcacagactcagcaggcggaggtggagcaccaagggcgcttggaagcggcctcttatctggctcctgcacctctgccccccttggattccgcaagctcagaggccaagattaaaggaggctcgtgctccagctggatgatgtgggaagagccagccaaggaggggggccagggcctcctccgtcttagaggctgcttgggatgcaggctgcttgggcggcagggggagtctgccagagccccgctggctcaggtggatgagagcttcctgtctgctcccccactgcccgcctcccagcacagggagcaagcgttgctgtctggtgcagtaattacaaggtgcagagcgggggcccttacctcgcacatgttgggttcaatgacagcccttcatttagcagcaattaccagctgaacctaaaggagggctccctctcctcccccacccagcccacccaatcgcctggcctcccaggccagacagcgtccacctcggcattgagccctagaaccacccatgctgtctgcagccattgcatctcagggctgcagcatcaccatggcaacgcggtgcttgcacaggttgaggggaagctgaggatgtgacttgtctctccaaggctgtggtgtctgtccccacacagccccagctccgaggcttctgcagaaggggcggagagaggactgacctgcaggttcgagtttcaagtgcttacctgcccaccacctctcccaggggcccacagtggaaggaaggttaatggctccaatatgtgaggacgtccacagttggtgttgtggtggcggtgagaatgggctgcagtttgcctgtgggagggacctgagccatcaggcagggcccggcataccttcatcttcactccggtacccttttctgccttgagggctcaagggattgtctccatctgtttctgctttatcctgctgtgaaaaacctgaaaatcccagtggcttgagagtagttacatggcaccaagagaattctcctcatggtacttgctgcagcttcctgcatcacacactagtgatggactgagggtggggactcccaggccatccatttaggtcgacagcattcagtgagtactggctacatggcagacactgccggacttggggacagagacattcatttttggagtcagccttcctcccagcccaggaaagtgatgaggcagtgggctggggaatggggaagaaagaacagaaaagaccgttcactgggcaccatctaggcctttgccataggttatttaatctgtaacagcccggtgcagtaaggactgattgtatttctttcctagctgtggaaactaagttccaagtggttaagcataacgatggctaaggatacaacctgcagacgccgtagagtgagagacgtgtctctctttgctgtgattagctgcgtgcttttggacacgttgctgatcttctccgagcctgtttccttgtctctacagaaggaataataatacatacacctgaaggaagctactgtgaaggtgaaataaaataatgtaggtaaagcacacagtgctcggctcatagtcatcaccactcaggaaatggagcaggaaggacgtcacataactcgcccagatgagaggaggagccagcgttggagctctggccttccaagatccccatctctgctgcagtgtctggtactgagcatgcacttaacagatgcttttttttttttttttttgacatggagtttttgctcttattgcccaggctggagtgcaatggcacgatcttggctcgctgcaacctccacctcccgggttcaagtgattctcctgtctcagcttcccaagtagctgggattacaggcacccaccaccatgcctggctaattttttgtatgtttagtacagggagctctaaagctgagatgcctttcagagttgtcccaagttggggtgagaggttcatggctttacgccacagcattttttgtatttttagtattttgtatttttgtatttcagtacatgttggccaggccggtcttgaactcctgacctcaggtaatccacctgccttgacctcccaaagtgctgggattacaggtgtgagccatcgcacccggcccagatgcttgttttttgaaggaatttccactagcggaaactaaagtggggattttacaggttctaacttccaaatgacttgccctgtaagaaggggctgctccctcccaccaccgcccattcctgccagcctccggtctcccagccatcccatggagttttcaccctaactgcacagccctgacatcagccacgtcccttcacccctgctttgtagtaaccaattagcttaacgtctgttcccatggttatttagtttcgttggcaactaacatacttcccagaaacaggccagcatctcccagtcccaccaccatcctgctggtggggccgtcctcttctggatgtcagatgagaactctcctgctggggaacaacagaaggacagaacatagaaccagaggaaaatgcattcaaatgcattccatcagtgtttctggacagtctacaatgtgccctggccggtgatcgctgctggagatatcgaagtcattaaaacatggtctctgtcctcaaggaa

SEQ ID NO: 183799 - DNA, 1672 bp, Homo sapiens
  Payload ID: 16215
  Gene Symbol: SLC35A2
  Gene Name: solute carrier family 35 (UDP-galactose transporter), member A2
  Uniprot ID: P78381
  ENST ID: ENST00000247138
  CDS Start-End: 224-1414
ggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccga

SEQ ID NO: 183800 - DNA, 903 bp, Homo sapiens
  Payload ID: 16215
  Gene Symbol: SLC35A2
  Gene Name: solute carrier family 35 (UDP-galactose transporter), member A2
  ENST ID: ENST00000376512
  CDS Start-End: 42-533
gtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcactgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttc

SEQ ID NO: 183801 - DNA, 1044 bp, Homo sapiens
  Payload ID: 16215
  Gene Symbol: SLC35A2
  Gene Name: solute carrier family 35 (UDP-galactose transporter), member A2
  ENST ID: ENST00000376515
  CDS Start-End: 82-738
atcgggggatgatctggaaagcgcgatcagtgaagcggacgaacggcaggataaggcgggtctagtgacaggaatgggccgatgaagctctgtagggatgctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggtt

SEQ ID NO: 183802 - DNA, 3047 bp, Homo sapiens
  Payload ID: 16215
  Gene Symbol: SLC35A2
  Gene Name: solute carrier family 35 (UDP-galactose transporter), member A2
  Uniprot ID: P78381
  ENST ID: ENST00000376521
  CDS Start-End: 323-1504
atcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttg

SEQ ID NO: 183803 - DNA, 865 bp, Homo sapiens
  Payload ID: 16215
  Gene Symbol: SLC35A2
  Gene Name: solute carrier family 35 (UDP-galactose transporter), member A2
  ENST ID: ENST00000376529
  CDS Start-End: 11-685
agatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttg

SEQ ID NO: 183804 - DNA, 1857 bp, Homo sapiens
  Payload ID: 16215
  Gene Symbol: SLC35A2
  Gene Name: solute carrier family 35 (UDP-galactose transporter), member A2
  Uniprot ID: P78381
  ENST ID: ENST00000413561
  CDS Start-End: 1-607
catggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttattt

SEQ ID NO: 183805 - DNA, 1739 bp, Homo sapiens
  Payload ID: 16215
  Gene Symbol: SLC35A2
  Gene Name: solute carrier family 35 (UDP-galactose transporter), member A2
  Uniprot ID: P78381
  ENST ID: ENST00000445167
  CDS Start-End: 34-762
gttgccgaggggacgggccgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttattta

SEQ ID NO: 183806 - DNA, 877 bp, Homo sapiens
  Payload ID: 16215
  Gene Symbol: SLC35A2
  Gene Name: solute carrier family 35 (UDP-galactose transporter), member A2
  ENST ID: ENST00000446885
  CDS Start-End: 351-877
cgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggt

SEQ ID NO: 183807 - DNA, 1563 bp, Homo sapiens
  Payload ID: 16215
  Gene Symbol: SLC35A2
  Gene Name: solute carrier family 35 (UDP-galactose transporter), member A2
  Uniprot ID: P78381
  ENST ID: ENST00000452555
  CDS Start-End: 11-1276
agatgccaacatggcagcggttggggctggtggttccaccgcggcgcccgggccaggggcggtttccgcgggtgcattggagccggggaccgccagtgcggagttgcttctcacttgggaggaagccgaggcgcgtggccagggtttgcctcagccattacctgacacctcagtaaggattccagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaagg

SEQ ID NO: 183808 - DNA, 1614 bp, Homo sapiens
  Payload ID: 16215
  Gene Symbol: SLC35A2
  Gene Name: solute carrier family 35 (UDP-galactose transporter), member A2
  ENST ID: ENST00000616181
  CDS Start-End: 11-1231
agatgccaacatggcagcggttggggctggtggttccaccgcggcgcccgggccaggggcggtttccgcgggtgcattggagccggggaccgccagtgcgggtgagacagtctgcccgagcagtcgcatgggaggcggagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataag

SEQ ID NO: 183809 - DNA, 1008 bp, Homo sapiens
  Payload ID: 16215
  Gene Symbol: SLC35A2
  Gene Name: solute carrier family 35 (UDP-galactose transporter), member A2
  ENST ID: ENST00000635015
  CDS Start-End: 11-541
agatgccaacatggcagcggttggggctggtggttccaccgcggcgcccgggccaggggcggtttccgcgggtgcattggagccggggaccgccagtgcgggtgagacagtctgcccgagcagtcgcatgggaggcggagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcactgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttcagaatggtgttgtgagaattaaatgaatgaattcacgtgcagtgcctagaaccacactgatatattgtaagcactatgtaagtatttgctgacattg

SEQ ID NO: 183810 - DNA, 1424 bp, Homo sapiens
  Payload ID: 16215
  Gene Symbol: SLC35A2
  Gene Name: solute carrier family 35 (UDP-galactose transporter), member A2
  ENST ID: ENST00000635589
  CDS Start-End: 11-1009
agatgccaacatggcagcggttggggctggtggttccaccgcggcgcccgggccaggggcggtttccgcgggtgcattggagccggggaccgccagtgcgggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttca

SEQ ID NO: 183811 - DNA, 706 bp, Homo sapiens
  Payload ID: 16215
  Gene Symbol: SLC35A2
  Gene Name: solute carrier family 35 (UDP-galactose transporter), member A2
  ENST ID: ENST00000635460
  CDS Start-End: 1-526
ggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttg

SEQ ID NO: 183812 - DNA, 486 bp, Homo sapiens
  Payload ID: 16215
  Gene Symbol: SLC35A2
  Gene Name: solute carrier family 35 (UDP-galactose transporter), member A2
  ENST ID: ENST00000634665
  CDS Start-End: 11-355
agatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcct

SEQ ID NO: 183813 - DNA, 533 bp, Homo sapiens
  Payload ID: 16215
  Gene Symbol: SLC35A2
  Gene Name: solute carrier family 35 (UDP-galactose transporter), member A2
  ENST ID: ENST00000634461
  CDS Start-End: 34-342
gttgccgaggggacgggccgggcagatgccaacatggcagcggttggggctggtggttccaccgcggcgcccgggccaggggcggtttccgcgggtgcattggagccggggaccgccagtgcgggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcactgagatgctaggatacttaaaagaaataatacctgtgaagagcccttgattggtgacagataagcttta

SEQ ID NO: 183814 - DNA, 2046 bp, Homo sapiens
  Payload ID: 16215
  Gene Symbol: SLC35A2
  Gene Name: solute carrier family 35 (UDP-galactose transporter), member A2
  ENST ID: ENST00000635285
  CDS Start-End: 16-1197
cgggcagatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccga

SEQ ID NO: 183815 - DNA, 584 bp, Homo sapiens
  Payload ID: 16215
  Gene Symbol: SLC35A2
  Gene Name: solute carrier family 35 (UDP-galactose transporter), member A2
  ENST ID: ENST00000635238
  CDS Start-End: 11-584
agatgccaacatggcagcggttggggctggtggttccaccgcggcgcccgggccaggggcggtttccgcgggtgcattggagccggggaccgccagtgcggctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcag

SEQ ID NO: 183816 - DNA, 2812 bp, Homo sapiens
  Payload ID: 16215
  Gene Symbol: SLC35A2
  Gene Name: solute carrier family 35 (UDP-galactose transporter), member A2
  ENST ID: ENST00000635628
  CDS Start-End: 11-193
agatgccaacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaactcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttg

SEQ ID NO: 183817 - DNA, 6162 bp, Homo sapiens
  Payload ID: 16216
  Gene Symbol: SLC35D1
  Gene Name: solute carrier family 35 (UDP-GlcA/UDP-GalNAc transporter), member D1
  Uniprot ID: Q9NTN3
  ENST ID: ENST00000235345
  CDS Start-End: 87-1154
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaacccatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttaaaaaaaaaaaaaaaaaagaaagaaggtcttgctctgtcgccagccaggctggagtgtaatggcgtaatcatagcagctcaccacagtctcaaactcctaggctcaagtgatcctcctgccttagcctgctaagtagctacgactataggcatgtgccattacgcctggctcgtttcttcctttttttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcatacagagactaatccaga

SEQ ID NO: 183818 - DNA, 1613 bp, Homo sapiens
  Payload ID: 16217
  Gene Symbol: SLC35D2
  Gene Name: solute carrier family 35 (UDP-GlcNAc/UDP-glucose transporter), member D2
  Uniprot ID: Q76EJ3
  ENST ID: ENST00000253270
  CDS Start-End: 64-1077
ggccgggcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgta

SEQ ID NO: 183819 - DNA, 889 bp, Homo sapiens
  Payload ID: 16217
  Gene Symbol: SLC35D2
  Gene Name: solute carrier family 35 (UDP-GlcNAc/UDP-glucose transporter), member D2
  ENST ID: ENST00000375257
  CDS Start-End: 49-540
gtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtaagactttggactgtttctgctcaataacttctttgtgtctttgacaataggcccagccccatcctcagtttttcattttccatctggctgctgttgaattgagcaggcaagagacaaatctgttgaagttagtggaatccccatgtgttcctatgaaagtcaaagtgggtcccacattggccagaaaatttctgagaatatatgaagagagcattgcaagatattaatatagcttttcttcacaaaaagcagtgaactgtttacatttcttactgaatgtttgtcttcattataacaactttacttgagaagttcttaggcatttgattaataataacagacttacaaag

SEQ ID NO: 183820 - DNA, 1361 bp, Homo sapiens
  Payload ID: 16217
  Gene Symbol: SLC35D2
  Gene Name: solute carrier family 35 (UDP-GlcNAc/UDP-glucose transporter), member D2
  Uniprot ID: Q76EJ3
  ENST ID: ENST00000375259
  CDS Start-End: 77-826
tcttccccggcccggccgggcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctatgt

SEQ ID NO: 183821 - DNA, 5703 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENST ID: ENST00000370153
  CDS Start-End: 102-1205
aagcgaatgaagacggcagtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgtctgggcacagtggctcatgcctgtaatcccagcactttgggaggccgaggcgggtggatcacaaggtcaggaattcgagaccagcctggccagcatggtgaaatcccatctctactaataatacaaaaattagctgggcatggtggtgcgcgcctgtagtcccagctactcaggaggctgaggcaggagaatttcttgaacacaccaggtggaagttgcagtgagccaagatcgtgccactgcaccccagcctgggtgacagagcgagactccgtctcaaaaaaaaaaaaaagaaaacacacacacacacacacacacccacagtatgaatgaaaaaaataaaatacttctttttttttttttttgagacagagtctcactttgtcgccaggctggagtgctgtggcgcgatctcggcttactgcaacctcccactccctggttcaagggattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaacttctcttgtcattttttggtatccagctattacctatttaatagatttattgaaatagattattttcataaagaactctat

SEQ ID NO: 183822 - DNA, 2347 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENST ID: ENST00000370155
  CDS Start-End: 393-1370
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcatt

SEQ ID NO: 183823 - DNA, 748 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  ENST ID: ENST00000422078
  CDS Start-End: 75-748
ttgaaaagattttattctgaaagactcttgccttctcaggcctttggttagagaaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacat

SEQ ID NO: 183824 - DNA, 1759 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENST ID: ENST00000427993
  CDS Start-End: 302-1279
cgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggagggtctcactgtcaccttggctggagtacagaggcgcaatctcagctcactgcaacttccacctccctggctcaagtgatctcccaccttagcctcccaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacattt

SEQ ID NO: 183825 - DNA, 5533 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENST ID: ENST00000465289
  CDS Start-End: 393-1055
gagaggtgtagcagaaagcagtgccccaggcctccacgcgacggtgaagcaggaaccaggggctgccagcagagcagcccaggtgcgtcgccttagggacagagctgccaagtgccgagctggggctgccagagccgagccgggaacggcatttgccagagccgaggcggaagccggagcatttgggggacgggaccgcgggaacccggaaacgcctgggctgcaccgagctggcggtggctacggcgacgggagccggcggcgctgcgggtcagcggtcgcgtaggacccagcggactcggcagcctggggcgcccggcggagctgaaccgcggcccccggtggtgggctcagccggtcgagctgcgcgggaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttgtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgtctgggcacagtggctcatgcctgtaatcccagcactttgggaggccgaggcgggtggatcacaaggtcaggaattcgagaccagcctggccagcatggtgaaatcccatctctactaataatacaaaaattagctgggcatggtggtgcgcgcctgtagtcccagctactcaggaggctgaggcaggagaatttcttgaacacaccaggtggaagttgcagtgagccaagatcgtgccactgcaccccagcctgggtgacagagcgagactccgtctcaaaaaaaaaaaaaagaaaacacacacacacacacacacacccacagtatgaatgaaaaaaataaaatacttctttttttttttttttgagacagagtctcactttgtcgccaggctggagtgctgtggcgcgatctcggcttactgcaacctcccactccctggttcaagggattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaa

SEQ ID NO: 183826 - DNA, 5218 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENST ID: ENST00000533028
  CDS Start-End: 228-1205
aagcgaatgaagacggcagtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtcacgtatcagttaaaaattcttacaacagcattattttctgtgtctatgcttagtaaaaaattgggtgtataccagtggctgtccctagtaattttgatgacaggagttgcttttgtacagtggccctcagattctcagcttgattctaaggaactttcagctggttctcaatttgtaggactcatggcagttctcacagcatgtttttcaagtggctttgctggggtttactttgagaaaatcttaaaagaaacaaaacaatcagtgtggataagaaatattcagcttggtttctttggaagtatatttggattaatgggtgtatacatttatgatggagaactggtatcaaagaatggattttttcagggatataaccgactgacctggatagtagttgttcttcaggcacttggaggccttgtaatagctgctgttattaagtatgcagataatattttaaaaggatttgcaacctctttatcgataatattatcaacattgatctcctatttttggcttcaagattttgtgccaaccagtgtctttttccttggagccatccttgtaataacagctacttttttgtatggttatgatcccaaacctgcaggaaatcccactaaagcatagttgtatactatctttaactggtttttcacgatggggcactaggaatctcgacattaatcttgcacagaggacttctacagagtctgagaagatatcatcatgctgaatctgatcatactgttttttaaaagtttaaggataagacatgtgtatatgtaacaaaacacattgcatctagaaatcaaaacttgaaagtatttccagggattaggattagaaggaatattagaggaaacttgaaatctgagtttaaaaagattttacctttttgattgctgcagaaatgtcctatgcactctttgcaagagcacacaacaaatgtcagataccaatttttgcaaattagatttaatcttattaaatgtttttatcttactctttctgtacagatatatcaaatcacatgaaatatttaaagtttgaaaattataattacctataaagctgtgaaaaatagaagtataatttgaaaaaacatttcacttatcagagatttttatatttatacaaaagattactaaatgaaggattgctaaatgtttttggttcaattacataaaaattaatattctgggtctgatctgtcagagaataaatatcaaatctaaatttaatgtagagatacatactatttctccatatgaattttaagatattttagtgcttcaagactgctgaaagcaatccagttgctcctgtgctagatggtagccagagaattttatagtaatggaggttagcccttaatctcttcattgcatttcatttctgtaaatcagattaagtccttaatattattttaaattaaaatttgtgtgtaattgccattaaattttcaaaatgtaatttaaaaggattaaatactcatttaataatttaaaataattattgtataatatctacatttggagaattttgaactatcaagcatatactgtatacagttagaaagttattaaatgaacattttactcattgatctgtaaaaacttctttaatctacaactgtttacaaaaacaacattcaaacaaatagtacagatgtcagtgacagaacaaaatgacttttcttggagacattccagattgccatattactttattttaaacagcgctatgactttaaatccaaggctgctcggaagatttttttaggtctctcataagcctattcttccctgatcacatgagtgggagaggtagccaaattttgaattccctttctgtgttcccacaagagctgctgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaacttctcttgtcattttttggtatccagctattacctatttaatagatttattgaaatagattattttcataaagaactctatacaaa

SEQ ID NO: 183827 - DNA, 563 bp, Homo sapiens
  Payload ID: 16218
  Gene Symbol: SLC35A3
  Gene Name: solute carrier family 35 (UDP-N-acetylglucosamine (UDP-GlcNAc) transporter), member A3
  ENST ID: ENST00000532693
  CDS Start-End: 310-563
agtgtgtgcctcagcgcctggtgcgtgcggagctagtgacgggtgggcccggctggggcccgtcattccttcagtgaacatcccatgagctctcgctcggtgttgagccctgtggtaggcacagatgcacccgaccagcacctggagctcaagaagccgcaggaacttaaagaaatggaaaggctgcccttgggtctcactgtcaccttggctggagtacagaggcgcaatctcagctcactgcaacttccacctccctggctcaagtgatctcccaccttagcctcccaagcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcaaatgtagtctaagagcactgaatcgagtactacatgatgaaattcttaataaacctatggaaacact

SEQ ID NO: 183828 - DNA, 6797 bp, Homo sapiens
  Payload ID: 16219
  Gene Symbol: SLC35B4
  Gene Name: solute carrier family 35 (UDP-xylose/UDP-N-acetylglucosamine transporter), member B4
  Uniprot ID: Q969S0
  ENST ID: ENST00000378509
  CDS Start-End: 301-1296
cggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaaaaaagaaaggttgttatggactggacacccctgaagcccattgcctaggccacagtggtgacggcaggatggccctgctcagcaccgcaagagccatggctgtccctgttggcccagccgggcactcacagggcagaagggtgggtctcaagtgggaggataaggcttcaccaccaggagattcccctctgcccgatgactctgttaagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaaacatgcctctctttgctaatcatttcagaggtccagttttcctttcactggacaatcttgaataggaggaacgctgttgctgtaatatgcgtagcttctgtgtgctcttgtgtagtctgtgtgtgatcaaagggcacggaagtggctgcactttcacatcccttttctttacttagctggaaccttacataccagtacatgctcctctgtaagcagctgaactcaccggccacttctctgtttgcctatagacaaagactgtgtgtgtgtgtgtgtatgtatgtgtgtgtgtgtggtgcacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccttttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcttcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatataaggaaatatgtctaatggacaccagttaatactttttaaaactactctttaaaaaaaaaatacgttccccttggttaactgattttttaatccagggtggacattttttcaacctttattaaaaagacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcagaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacattcataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatcacttgcgattgccagtcatttctgtgccagttgctttcattccagagaatggcctcattctccaaaaaaagatgatgattttagaagtaggatttcctaacaaattatgtggtggggagggacggcggggattttattcatcccgtctgagctcttcatacagtattaccattaggttttaagaacaaagatgggggaggagggagtagaaagctgagagtacgtagaacagctacaagacattagtgggtattcagattttgagctgtgtaaatatcaaacatcggcttccagccttaagagttatttgagcagagagttaaggaggaatgggagattttgtgaataaaatgttttgccaaactgaa

SEQ ID NO: 183829 - DNA, 1379 bp, Homo sapiens
  Payload ID: 16219
  Gene Symbol: SLC35B4
  Gene Name: solute carrier family 35 (UDP-xylose/UDP-N-acetylglucosamine transporter), member B4
  ENST ID: ENST00000416907
  CDS Start-End: 153-551
agaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttg

SEQ ID NO: 183830 - DNA, 1033 bp, Homo sapiens
  Payload ID: 16219
  Gene Symbol: SLC35B4
  Gene Name: solute carrier family 35 (UDP-xylose/UDP-N-acetylglucosamine transporter), member B4
  Uniprot ID: Q969S0
  ENST ID: ENST00000470969
  CDS Start-End: 147-842
ggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctggtgagtttggggttagacagtagaattacctgacagtttctgaggcagagtctcagttttactcttgacttgacctcggcctttttcataatcctattcaaatcatgtgttcctttcgaaaatgtctccattccactttccagtcattgcagcagcaaaagcttttacaggggtttctcaattatttacaaatgaagtaaaagaatatcttcga

SEQ ID NO: 183831 - DNA, 3041 bp, Homo sapiens
  Payload ID: 16220
  Gene Symbol: SLC35A4
  Gene Name: solute carrier family 35, member A4
  Uniprot ID: Q96G79
  ENST ID: ENST00000323146
  CDS Start-End: 1108-2082
gtaaacgggcgtctggatccccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccatga

SEQ ID NO: 183832 - DNA, 3617 bp, Homo sapiens
  Payload ID: 16220
  Gene Symbol: SLC35A4
  Gene Name: solute carrier family 35, member A4
  Uniprot ID: Q96G79
  ENST ID: ENST00000514199
  CDS Start-End: 1687-2661
cgtggtcttcactctccttgacctttttagttccggggagaagcgactctggagcggctcaggagtgaggatgtcccttgtttcttctgcggctcctgtcaactgcctcaacagtgtggagtggtgtggggagagcattcggcgaggcgggaggagccgtggatcccccagatgtcccctcctgggaaccatcacgaacccgttactagcacagactcaaaaacattcacccttaaacactcctcactttaccccattccctagctcccgaaattttcttcccagtgacacgatgtttccaatcacacggacactcacaccaccctcattcaaacactcctttgcatacattctgaatttcatacttatatgcgatcaaaatcactcagtccatttacttacacacttgccgacagtcttttttgtcattctcagtcacatccagtcactcacattcagtttgggatgtccttgggaagaaagaggtaaagcccatccaggaaccaagacaataaaattgtccaggaaactgcctcggtccattactcaccattggtctagaagctcagcattacccacacatttactaaatgtcaggcactagaacatagtagccaagacagactggtcacgactttcaaggagctcataatggagtcagtagtggtttcctgatggacctaattaaaggtccctagctgtccctcctgcctttcctacatactgcttgctatataaaattcttgtcaaggttgatgtaagttactggttcagatcccatctgtcagtcccttcctggccctcatttgaattctgtgcttttcaatgcttgtctttctttgccactgccatctcaggaagcttttataggaaaaggtctttctggctcaccccatcccctcccaattcccagcttctgatggaattgagcaaggggtggggcttagtcagactgctggagccagcctctcgcttgtcctaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcca

SEQ ID NO: 183833 - DNA, 2657 bp, Homo sapiens
  Payload ID: 16220
  Gene Symbol: SLC35A4
  Gene Name: solute carrier family 35, member A4
  Uniprot ID: Q96G79
  ENST ID: ENST00000612662
  CDS Start-End: 729-1703
gcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagc

SEQ ID NO: 183834 - DNA, 683 bp, Homo sapiens
  Payload ID: 16220
  Gene Symbol: SLC35A4
  Gene Name: solute carrier family 35, member A4
  ENST ID: ENST00000623481
  CDS Start-End: 17-328
aagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttcccc

SEQ ID NO: 183835 - DNA, 2444 bp, Homo sapiens
  Payload ID: 16221
  Gene Symbol: SLC35A5
  Gene Name: solute carrier family 35, member A5
  ENST ID: ENST00000261034
  CDS Start-End: 222-929
gggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttacacatttctgctctcctttctcctaagtttcatgcagatgaatataaggtaatatactattatataattcatttgtgatatccacaataatatgactggcaagaattggtggaaatttgtaattaaaataattattaaaccta

SEQ ID NO: 183836 - DNA, 4399 bp, Homo sapiens
  Payload ID: 16221
  Gene Symbol: SLC35A5
  Gene Name: solute carrier family 35, member A5
  Uniprot ID: Q9BS91
  ENST ID: ENST00000492406
  CDS Start-End: 284-1558
ataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttacacatttctgctctcctttctcctaagtttcatgcagatgaatataaggtaatatactattatataattcatttgtgatatccacaataatatgactggcaagaattggtggaaatttgtaattaaaataattattaaacctatgtcttgtgttgccactctgtcatttagggtgggatgtagagtacttttaatcttaaaaaatagagtgagacaaaaacctacacaacttttaaaactttctctttaagtagatctttacttctaacaataacaaaggcattttcatcagttatgtgaaatacgaagattatatctattatggcgatttattttaaaggtaagggaaatgaggtacagcaggacctttctaggaaatgtggcatacaaaacatttttatctcataaaacataaaaattacaaaaatattcttacaaaggtatcacatacagaatacattaaatagcagatttcagtagtgcatggagattgattttcttatttacgattactttttttcctcaccttcctctttggaaagcattttttgcacaaagttaagtttacttatgttaacttgccacttaatgagagaggaagagaaagagtgagagcacaagatcatgtgctggaactaaaaatgttctattcaacccagcaatccctctactgggtacctacccaaaggaaaataaatcgttttatcaaaaagacacttgcagtggtatgtttatcacagcagtattcacagtaacaaaatcatggactcaacctaagtgtccatcagtggtgcctggaataagaaaatgtggtacatatacaccatggaatactttgcagccataaaaaataatgaaaccatgtgctttaaagccacatggatgcagctggaagccattatcctaactgaaataattcagaaacagaaaatcaaataccacatgttctcacttataagtgggagctaaacagtgggtacatgtggacacaggattccaaagtgagaagggtggtgtattagtccattctcatgctgctacaaagaaatacccgagactgggtaatctataaagaaaaggggtttaaatgactcgcagttctgcatggctggggaggaggcctcaggaaactcacaagcatggctgaaggcgaaacagaagcaagcaccttcttcacaaggcagcaggagagagagtgccaacaggggaaatggcagatgcttataaaaccatcagatctcatgagaacttactatcatgagaacagcatgggggaaactgcccccatgattcaattacccccacctggttccttcctcaacacctggggattatggggattacaattcaagatgagatttgggcggggacagaaagcctaatcatatcagatgggaaggacatgagggttgacaaaatatgtattgggtacaatgttcactgtttgagtgatgggtccactagaagcccaaacttcaccattatgcaatgtaccatatatacgcaatgtaacaaacctgtacatgtaccccttcaatctgaaataaaagttgttttttttttt

SEQ ID NO: 183837 - DNA, 486 bp, Homo sapiens
  Payload ID: 16221
  Gene Symbol: SLC35A5
  Gene Name: solute carrier family 35, member A5
  ENST ID: ENST00000468642
  CDS Start-End: 223-486
agcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctgg

SEQ ID NO: 183838 - DNA, 575 bp, Homo sapiens
  Payload ID: 16221
  Gene Symbol: SLC35A5
  Gene Name: solute carrier family 35, member A5
  ENST ID: ENST00000484995
  CDS Start-End: 134-575
acagcgcgcgaagacggggtgcgcgatcctcgcaccccaggcagcccgcgacggaccggacccagctgtcacccagccgcgagggagggcagcggggccgaagggagacctgaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaact

SEQ ID NO: 183839 - DNA, 840 bp, Homo sapiens
  Payload ID: 16221
  Gene Symbol: SLC35A5
  Gene Name: solute carrier family 35, member A5
  ENST ID: ENST00000494706
  CDS Start-End: 392-751
ggaacgagagacttggaaaagaaagggacatagacaaagtatagagaaagaaaaaagggggcccaggggaccggcgctcagcacacggaggatctctgccagcctctgagttccattagtatttattgatcattattgggtgtttctcggagagtgggatgtggcaggatcataggatagtagtggagagagggtcaacaggtaaacacgtgaacaaaggtctctgcatcataaacaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaacaagcctcaagttccggaatacgcacctaggcaagaaaggatccgagatctaagtggcaatctttgggagcgttccagtggggatggagaagaactagaaagacttaccaaacccaagagtgatgagtcagatgaagatact

SEQ ID NO: 183840 - DNA, 1850 bp, Homo sapiens
  Payload ID: 16222
  Gene Symbol: SLC35B1
  Gene Name: solute carrier family 35, member B1
  Uniprot ID: P78383
  ENST ID: ENST00000240333
  CDS Start-End: 256-1335
ctaggacaccctgtggtgctctgggtcgcagttgtcctcagagttgcctgattggaaaaatctccagggcgagggatcagtctcgaggctgccggttcccctggccctcagggatggagccaaggtcccagggcgggttttctttcctaggaagtggttgctgggttctgaggagtttcccccttggcagccatgagccggcagttctggtagtgactgctgggccctgctggacagcggtcgcatgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 183841 - DNA, 581 bp, Homo sapiens
  Payload ID: 16222
  Gene Symbol: SLC35B1
  Gene Name: solute carrier family 35, member B1
  ENST ID: ENST00000511763
  CDS Start-End: 1-581
ggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctcc

SEQ ID NO: 183842 - DNA, 943 bp, Homo sapiens
  Payload ID: 16222
  Gene Symbol: SLC35B1
  Gene Name: solute carrier family 35, member B1
  ENST ID: ENST00000503334
  CDS Start-End: 263-943
ctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagcccc

SEQ ID NO: 183843 - DNA, 845 bp, Homo sapiens
  Payload ID: 16222
  Gene Symbol: SLC35B1
  Gene Name: solute carrier family 35, member B1
  ENST ID: ENST00000508520
  CDS Start-End: 84-845
gttgtcctcagagttgcctgattggaaaaatctccagggcgagggatcagtctcgaggctgccggttcccctggccctcagggatggagccaaggacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgcc

SEQ ID NO: 183844 - DNA, 481 bp, Homo sapiens
  Payload ID: 16222
  Gene Symbol: SLC35B1
  Gene Name: solute carrier family 35, member B1
  ENST ID: ENST00000502268
  CDS Start-End: 1-114
acaagaggaaagtatggggaaggagccaagcaggagacgttcacctttgccttaactttggtcttcattcaatgtgtgatcaatgctgtgtttgccaagatctgtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatc

SEQ ID NO: 183845 - DNA, 1320 bp, Homo sapiens
  Payload ID: 16222
  Gene Symbol: SLC35B1
  Gene Name: solute carrier family 35, member B1
  ENST ID: ENST00000507773
  CDS Start-End: 147-620
agggatggagccaaggtcccagggcgggttttctttcctaggaagtggttgctgggttctgaggagtttcccccttggcagccatgagccggcagttctggtagtgactgctgggccctgctggacagcggtcgcatgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgggaatcctgttcactggggagctctgggagttcttgagctttgctgaaaggtaccctgccatcatctataacatcctgctctttgggctgaccagtgccctgggtcagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaa

SEQ ID NO: 183846 - DNA, 548 bp, Homo sapiens
  Payload ID: 16222
  Gene Symbol: SLC35B1
  Gene Name: solute carrier family 35, member B1
  ENST ID: ENST00000511657
  CDS Start-End: 320-548
aaaagagcaggctgctagaagaggagcctcgacctagagagcagcccagagtccaccaggtggccggagatttgggccaattaagtagggggttggaggtagtagtaggaagacctgaggtcagtcttgccctggcaattcgtgccagcaagtgaagacccaacacttgcatgaggaagggatccaacgaggagctcattaatgggaaatattcaggagcgcggccgaagggtttgcgccattgttgaacaagaggaaagtatggggaaggagccaagcaggagacgttcacctttgccttaactttggtcttcattcaatgtgtgatcaatgctgtgtttgccaagatctggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtg

SEQ ID NO: 183847 - DNA, 633 bp, Homo sapiens
  Payload ID: 16222
  Gene Symbol: SLC35B1
  Gene Name: solute carrier family 35, member B1
  ENST ID: ENST00000514907
  CDS Start-End: 72-633
gttgcctgattggaaaaatctccagggcgagggatcagtctcgaggctgccggttcccctggccctcagggatggagccaagaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgctgctgggaatgg

SEQ ID NO: 183848 - DNA, 862 bp, Homo sapiens
  Payload ID: 16222
  Gene Symbol: SLC35B1
  Gene Name: solute carrier family 35, member B1
  ENST ID: ENST00000515850
  CDS Start-End: 6-862
ctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgacccgagtcggcccccttttggtactcccagatgcttgcaaacaacctattcgtcctcggccttggtgccatagccgaaataccgtctcctcctgcctgggaacaagaggaaagtatggggaaggagccaagcaggagacgttcacctttgccttaactttggtcttcattcaatgtgtgatcaatgctgtgtttgccaagatcttgatccagttttttgacactgccagggtggatcgtacccggagctggctctatgctgcctgttctatctcctatctgggtgccatggtctccagcaattcagcactacagtttgtcaactacccaactcaggtccttggtaaatcctgcaagccaatcccagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttgctattatcgctgaccctggatggactgactggtgtttcccaggaccacatgcgggctcattaccaaacaggctccaaccacatgatgctgaacatcaacctttggtcgacattgct

SEQ ID NO: 183849 - DNA, 2359 bp, Homo sapiens
  Payload ID: 16223
  Gene Symbol: SLC35D3
  Gene Name: solute carrier family 35, member D3
  Uniprot ID: Q5M8T2
  ENST ID: ENST00000331858
  CDS Start-End: 166-1416
cgcaagaacgcctggccggagctgccctctgcagccgagccggcgccccctgcccttcgccgccgcgctgggcgggcgcccccgccgccctcactccgctgctcccggctcctcgcgcgcaggtcgcggagctccgccaccgctgggtgcggcgaggccggcgcgatgcggcagctgtgccggggccgcgtgctgggcatctcggtggccatcgcgcacggggtcttctcgggctccctcaacatcttgctcaagttcctcatcagccgctaccagttctccttcctgaccctggtgcagtgcctgaccagctccaccgcggcgctgagcctggagctgctgcggcgcctcgggctcatcgccgtgccccccttcggtctgagcctggcgcgctccttcgcgggggtcgcggtgctctccacgctgcagtccagcctcacgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggagccggcgacctgacgggcgaccccatcgggtacgtcacgggagtgctggcggtgctggtgcacgctgcctacctggtgctcatccagaaggccagcgcagacaccgagcacgggccgctcaccgcgcagtacgtcatcgccgtctctgccaccccgctgctggtcatctgctccttcgccagcaccgactccatccacgcctggaccttcccgggctggaaggacccggccatggtctgcatcttcgtggcctgcatcctgatcggctgcgccatgaacttcaccacgctgcactgcacctacatcaattcggccgtgaccaccagcttcgtgggtgtggtgaagagcatcgccaccatcacggtgggcatggtggccttcagcgacgtggagcccacctctctgttcattgccggcgtggtggtgaacaccctgggctctatcatttactgtgtggccaagttcatggagaccagaaagcaaagcaactacgaggacctggaggcccagcctcggggagaggaggcgcagctaagtggagaccagctgccgttcgtgatggaggagctgcccggggagggaggaaatggccggtcagaaggtggggaggcagcaggtggccccgctcaggagagcaggcaagaggtcaggggcagcccccgaggagtcccgctggtggctgggagctctgaagaagggagcaggaggtcgttaaaagatgcttacctcgaggtatggaggttggttaggggaaccaggtatatgaagaaggattatttgatagaaaacgaggagttacccagtccttgagaaggaggtgcatgtacgtacctatgtgcatacacttattttatatgttagaaatgacgtgttttaatgagaggcctccccgttttattctttgaggagtggggaagggaagaaaagaaagaagctgaaaggtactgacacagagcaacaaaattagcacctgtgtgaattatttagtgtgacttcacctgaggcatcacagagacaaaagaatgtgaagctacttaacaaagtaaggcaacgtttctgcttcagactcctggcacatttactttttgtcattataaccataactaaatatctgcatgtaccaagagtccctaagccaccccctccaaagatggagtgtagaaatgatgacagcacttagtaagttcaaagatgacattcagggatgcattttttgatgatagaactacagtttttatcgccagctgggcaaagagtatattgctgaaatgatatataaatatattgaattgatgtttactgtttatagtcatctgaaatatcatatttactctgattctactcacttgttttttaaaaataagtgtcctattattgtattatatattgatagaaactgttaaagctattttgaaaatatgagttcttagctttaatcatgaagtctgaagtttgctttcagtaattattttaaaagttgttttggttcattgctttataatatttattattgaatgccaaacctgttcttttttttactgtgtccaatattctttcaagcaaatgcaatggctggaatataattcagaattaactgaaacccagccagaagagggaccacctgtaaagcaagtcctttcaagtttcactgcacatcccaaaccatgttacaaaaagagcaactgctatattcacattatgatatttttctatcttaaatttgtcaaaataaagtatgagtctaactattaaa

SEQ ID NO: 183850 - DNA, 3691 bp, Homo sapiens
  Payload ID: 16224
  Gene Symbol: SLC35E1
  Gene Name: solute carrier family 35, member E1
  ENST ID: ENST00000409648
  CDS Start-End: 1-316
tatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgggtctgccttcagagaatgtgttataaatgaatgcaagtgcctgcggtgaggaggaggccagtgcgattcttccagactcgagttagaaaggaaaaacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaa

SEQ ID NO: 183851 - DNA, 552 bp, Homo sapiens
  Payload ID: 16224
  Gene Symbol: SLC35E1
  Gene Name: solute carrier family 35, member E1
  ENST ID: ENST00000421082
  CDS Start-End: 205-552
ttaaaccagattggttgggttcccttcccagaagatagatatctatgcaagcaggaagaaaatagcatggaaatcctaaccgatcaccttagggagcgacccctgggagaacaggctggcccaacatgaaggcatcctggtgggctcatatatattacaggggctattcctccagtgaggttccccgcagaagctgcagggtgtatggcacagacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactg

SEQ ID NO: 183852 - DNA, 1343 bp, Homo sapiens
  Payload ID: 16224
  Gene Symbol: SLC35E1
  Gene Name: solute carrier family 35, member E1
  ENST ID: ENST00000436553
  CDS Start-End: 1-1035
agtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtgga

SEQ ID NO: 183853 - DNA, 5099 bp, Homo sapiens
  Payload ID: 16224
  Gene Symbol: SLC35E1
  Gene Name: solute carrier family 35, member E1
  Uniprot ID: Q96K37
  ENST ID: ENST00000595753
  CDS Start-End: 19-1251
ggcggccgctcgggcaggatggcggcggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 183854 - DNA, 2455 bp, Homo sapiens
  Payload ID: 16224
  Gene Symbol: SLC35E1
  Gene Name: solute carrier family 35, member E1
  ENST ID: ENST00000611092
  CDS Start-End: 219-542
ctgccaggtggatacagggaggcagggtcaccgctgcccactgaagtgctgtctttaccttccggtctctgcagacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggctcctcttcccccagcacggggactatcagtacggcccaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctc

SEQ ID NO: 183855 - DNA, 1430 bp, Homo sapiens
  Payload ID: 16225
  Gene Symbol: SLC35E2
  Gene Name: solute carrier family 35, member E2
  Uniprot ID: P0CK97
  ENST ID: ENST00000246421
  CDS Start-End: 417-1217
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggtcccgcaggccctgcaccgagtcgccttgtccatggcgctgccctgccccatgcttcctgcgtcctgagtaggaggtatctccgagacaggaaaagtggccgctctctctcactttttctggaactcatggtggtctcctgggcttggtcactgtctctcaccagcatgtttctttgtgcggtcaggaattatttccaaatgctcctgaagcctagtgttttagtgaacattagtgattgttagcagtggttcaaaaaaaaaaaacttttttttttttttt

SEQ ID NO: 183856 - DNA, 2078 bp, Homo sapiens
  Payload ID: 16225
  Gene Symbol: SLC35E2
  Gene Name: solute carrier family 35, member E2
  Uniprot ID: P0CK97
  ENST ID: ENST00000355439
  CDS Start-End: 762-1502
gcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgtcctcgggctccacccggggagctgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggcccagtaaatgcggatgtttatcttccattgtttgtttcctgagattcagatgtctaaagcatttttctgtgacttttcaaggcaagaggaaaacctgacatatggaaagggaattaattgctcgttttatcctcttctcctgcaatgctctgaatccatgggtttggagtggggccctgggagttgggggaagcaccatacccagtgagtctgcactttgaggacccactgccagtgtcagcttcaaaatcacattgtaaaaggcccggcgcggtggctcacgcctgtaatcccagcactttaggaggacgaagcaggcggatcacttgaggtcaggagttcgagaccagcctggccaatatggcgaaacctcgtctctaccaaaaatataaaaattagccgggcgtggtggcgcgggcctgtggttccagctactcgggaggctgaggcaggaaaattccttgaacccgggaggaggctgcagtgagccaagaccacgccactgcactccaacctgggcggcagagcaaggctccgactcaaaagtaaatacatgaataaataaaataaaatcacatcgtaa

SEQ ID NO: 183857 - DNA, 2156 bp, Homo sapiens
  Payload ID: 16226
  Gene Symbol: SLC35E2B
  Gene Name: solute carrier family 35, member E2B
  ENST ID: ENST00000614300
  CDS Start-End: 842-1582
tggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcgtcctcgggctccacccggggagctgtgcccagacagcagaagggaaggatgtcacttctgagatgaggttcagaaaggtctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcaggcccagtaaatgcggatgtttatcttccattgtttgtttcctgagattcagatgtctaaagcatttttctgtgacttttcaagtcaagaggaaaacctgacatatggaaagggaattaattgctcgttttatcctcttctcctgcaatgctctgaatccatgggtttggagtggggccctgggagttgggggaagcaccatacccagtgagtctgcactttgaggacccactgccagtgtcagcttcaaaatcacattgtaaaaggccgggcgcggtggctcacgcctgtaatcccagcactttaggaggacgaagcgggcggatcacttgaggtcaggagttcgagaccagcctggccaatatggcgaaacctcgtctctaccaaaaatataaaaattagccgggcgtggtggcgcgggcctgtggttccagctactcgggaggctgaggcaggaaaattccttgaacccgggaggaggctgcagtgagccaagaccacgccactgcactccaacctgggcggcagagcaaggctccgactcaaaagtaaatacatgaataaataaaataaaatcacatcgt

SEQ ID NO: 183858 - DNA, 6283 bp, Homo sapiens
  Payload ID: 16226
  Gene Symbol: SLC35E2B
  Gene Name: solute carrier family 35, member E2B
  Uniprot ID: P0CK96
  ENST ID: ENST00000617444
  CDS Start-End: 762-1979
gcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcgtcctcgggctccacccggggagctgtgcccagacagcagaagggaaggatgtcacttctgagatgaggttcagaaaggtctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccactgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccgtcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccaggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgga

SEQ ID NO: 183859 - DNA, 5948 bp, Homo sapiens
  Payload ID: 16226
  Gene Symbol: SLC35E2B
  Gene Name: solute carrier family 35, member E2B
  Uniprot ID: P0CK96
  ENST ID: ENST00000611123
  CDS Start-End: 428-1645
tccgtggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccactgttcctatcatcatctagcacctgtccggttccccacgtgagccttgggcaggacgctgcagtgttgatggtttgggttacgtggcgtttacctgggcgccgtccttactgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgcggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggccttgtccacctccccgtcgagaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcagtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccaggtgtggttacttccactgggtgtgtccatggtcgtggtctgtgcttttgtaaacgaacagaacacttgaaccacctcccgaattgggtcatcggcttctttacgttgatacttaagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgg

SEQ ID NO: 183860 - DNA, 17791 bp, Homo sapiens
  Payload ID: 16227
  Gene Symbol: SLC35E3
  Gene Name: solute carrier family 35, member E3
  Uniprot ID: Q7Z769
  ENST ID: ENST00000398004
  CDS Start-End: 273-1214
gcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggcggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatgtgtgtgtgtgtgtgtgtatacatatatacacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcatttataaagtataataaagatgactgtaagacaaaatccaattctaaaagtatgatttttttctagtagaaaattgatgtaagaaatcatacattattcatacatttataggtcatctctttgagttttcagtgaactatagaaactatatggagttaaaaaacaaaacggcagccaatctcagtggctcacacctgtaatcccagcactttggaaggttgaggcaggcagatcacctgaggttgggagttcaagaccagtctgaccaacatggaggaatcccgtctctactaaaaatacaaaattagccaggcatggtggcacatgcctgtaatcccagctgctcgggaggctgaggcaggagaatcgcttgaacccaggaggcagaggttgtggtgagccgagatcatgccattgctctccagcctgggcaacaagagtgaaactccatctcaaaaaaaaaaaaaaaaaatagccctatgtttaaatggctcaaagaaaagactataaatggaattgaacatgtttgttagctgtttgagcattttatattggtaaattttttattttcttattttttgtcttacagtcgaccaggctggaatgcagtggcacaatcatggctcactgcagcctcagcctcctgggctcaagcaatcctcctgcctcaacctccccagtagctgggactacaggtgcacaccaacatacctggctgatttttatattttttgtagagacagagttttgccatgttgctcaggctgatctcaaactcttgagctcaagccatctgtctgcctcagcctctcgaagtgctgggattacaggcctgagccaccacacctggccagtaatttcttaatcctacctccctgcttctattgcctagcccgtacatttgaggcttccatggagctttctgtggtactgaaacacttggagtgaactgcaaacttggagtgaactacatccaacctttctaaggtggctggggaaaattcttgtacagcaagttgggacaaaatagccatatagaaacagccatataagatcccaatatagaaaaattgggatattagaggaaatacatgatttccatttatggagtgctacatgtttgcaaaatgtatttctgcttttcatcttcttgacatctgaatattaaaagcagttgttgataatttcatataataaattgagacatatcattactcttgtaataattcattttctaaatgttatttatcaactttcatggagaaaacaactcttaggagaacaaagaccagcccgggcaacatggcaaaaccctgtctgcaaaaaatacaaaaattagccgggcctagtggcacgtgcctgtagctccatctactcaggaggctgaggtgggaggattgcttgagcccagaagatgcaggttgcagtgagccgagatcatgccactgcacttcagcctgggcgacagactggactctgtctcgggaaaaaaaaaaaaaaaaaaagggaagagcgacaaaatataccttttgataagacagtaaattttatgttttgtgttttttaacacaataaaaatatatatacacacatataatatacctttggggtttttaggatttttttttcctggactctgaaatgagaagcctcgctgaaaatctgttttggagaattccagtttgtcagtcagtctcttgtgtaattagtacgtgtggcttccttctttgttttaaatattctttggttcttctcattttacaaagatatatattttttgtgctaaggacagagcaattagtttttaccagataagcctcgggtattatgtttgtctaagaaacattctctgtgtatgtttaaattgtaattatttcccaaaagctgaggaaaatgtttcagcacagtgaggatttgacgtctgcactgagaacagctgagtttatttgtgccatttagaaattcgtaactgtaggctgggcgcagtggcttacgcctataatcccagcactttgagaggccaaggcgggtggatcacctgaggtcaggagtttgagaccagcctggccaacatggcgaaacactgtctctactaaaaatacaaaaattagctgggcatggtggcgggcgcctgtaattccagctactcgggaggctgagacaggagaatcacttgaaccagggagtcggaggttgcagtgagccgagactgcgccattgcacaccagcctgggtgacgagagtgaaactctgtctcaaaaaaagaaaaaaaaaaagaaatttttaaccgtaaatagaacttggggagggtgttatataatatatgtgtcagtaggaaggcagtaagaagattggagtaagacaggatggggttacatgtatataaatgaataaaataagtactgctaaaacttgagtctgataaacttttttgccccgaagataatcatcccactgaaaagaaaactctggggaaaatatgccagatactaggaccaagcacggagacaaaccagatacagtgctttcaaagaaaacatgcttgctgtcctttgttaccagtgtaattgtaattattgtttattctgtgttaagtgactgaatttcaatttttaccttttaaaaataaagagaacctctttttacttctgtattgcatatgagagctgatggaagaaggatggcatctgtgtaacatatgcatggtaacgctgacgtgttcagctgttcatatttggcctgtccaaataagcagaaatgaatgaaacaaaattccatctccttttagaaataacataaaggagaaatctatctctgtgaaatgaagtaagcattcttctgtttcactttttaaaatacttttaaaatcttgctgttttcaacctattaatgactttttgaaattgtatttcaaagcagaaacattaggttgggtatggtggctcacgcctgtaatcccagcactttgggaagctgaggtgggcagatcacctgaggtcaggagttcaagaccagcctggccaatatggtgaaaccttgtctctactaaaaatacaaaaattagccaggtgtggtgttgcatgcctgtagtcccagctacttgggaggctgaggcaggagaatggcttgaacccgggaggcggaggttgcagtgagccgagatcacgccactgcactccagcctgggcaacagagcaagactccatctcaataataataataataataacaaagcagcaacattaatcaagcactctgtattcactccgtcagtaaatactgtcgggtgaatgactgcagaatggccaaaggtgagagtttgattaaaagaaaggagaccttggccgggcacggtggctcacgcctgtaatcccaacactttgggaggctgaggtgggtggatcacctgaggtcaggagttcgagaccagcctggccaacatggtgaaaccccatctctactaaaaatacaaaaaaattagctgggcgtggtggtggatgcctgtaatcccagctacttgggaggctgaggctggagaatcccttgaacttgggaggcggaggtttcagtgagccaagatcatgccattgcactgcagcctgggcaacaagagcaaaactgtctcaaataaataaataataaaagaaaggagaccggatttattagatgtggtccgttttgtctttctgttcccaaacttaaactggattatacctgctaatatcaggaatataatgataattgcattcattcaacaaaaatttattgagcatatactgtgtgccaggtactgtcctaggcattatggatataaaacagtttttatgtagagacagtcctatatttcctgtgatcttaaggaacatttgtctagtattagagataggactaattaaacaaaaacaagacaagaataattaaacagcaaactcaatgaatgctaaagggaacatcgttctgtgagcacataacaaaagaatctggcccaggcttggcacttgtggagggagtccatgaggaaagtttgagctgcagtcatagatacatagaagttagctagctaggcagagggagggtattgcattctggaaagagggaatagcacatacaaatgcctagtggttggaggaattgtgatgcttttaaagaactgtaaaaaggatggagtctggagactaaatttgggagtggggagacatggtgtgtcctgcacctggaaatgtagatagacctcaggccatacaatacctggaggctatggtaagcatctttagtaagagcaagggggagtgttgtgagcactgtcacagtaaatttctttttttgaaattagtggaggagaaccagagagatgccaggagaccagttagttgggagatgactgtagttagagatggtggtagcttcaaaggtagtggaatgagataagtggaaataattgagtagctggagtcaactggactggagatggattggaaatggagggcatgagaaggggtgaagttaaggatcacacttcagctgggcacagtggctcatgcctgtaatcccagcactttgggaggctgaggtgggtggattgcttgagtccaggagttcgagaccagcctgggcaaacatgatgaaaccccatctctacaaagaatacaaaattagctgggcatggtggtgtgggcctgtggtcccagctactcaggaggctgaggcgggaggatctcctgagcccaggagtttgaggcttcagtgcgccatgatcacgccactgcactctagcctgggtgacagagtgagtccctgtctcaacaacaacaaaaaatcacacatgtctgatttgcgcagcttgatagagaatggtgccattctctgaactaggaaacacaagaagaggactgaggagagggatgaggcagaggaatattatgggccttcttgatactgagatatccaattaaagatgttggccaggcatggtggctcaggcttgtaatcccagcactttgggaagctgaggcagtcagatcacttcagatcaggagtttgagaccagcctgaccaacatggtgaaaccccgtctctactaaaagtacaaaaattagctgtgtgcggtggtgcatgcctataatcccagctacttaggaggctgaggcaggagaatcgcttgaatctgggaggcagaagctgcagtgatctgagattgcaccactgcactccagcctgggtgacagagagagactctatctcagaaaaaaaaaaaaaagatgttaatcaaataattagtttatagaggcccagaactcaggaaaatgtttagttgaggtggagataaaacaggagtttctggggtatgcctgataaggaggaaaacagaccaagatgagcttgctgaagaagatagcataaagcaagaacagactataactgaagttgaggaactctggtatacaatgatagaacataatgctgcaaaagaaacagagaaggaacaaagaggtgggaggaaaatgggccgggcactgtggcttatgcctgtaatcccaacatttttgagaggccaagctgggtggatctcttgagctcaggagttcaagaccagcctgggcatcatggcaaaaccctgtctctacaaaaaatacaataattaatagtttcgaaagaaagaaacctgccaagcaaaagtccggtctcagcccgggagctagtagcatgcagtggaacaggtctcacctggacggcagcactgggacttccagtccagactctgccattcactggtatagcctttggcaaagcctttgggcagcttgctcaaatcttacttctcagtttcttcacctataaaatgagggctttgatccaaataatttccaggggactgtccagctccaaaatcccctgattctgctttttcagattaaaattataatttctcatttgcttataataaaagtagattgaataaattaatcagaagggtttggtttgtttgaccttttttttaattttaatttttattttttattttttgagacagagtttcctctgtctcccaggcttggttgttgtggctcaatctcagttcactgcaacctccgcctcccgggttcaagcgattctcccgcctctgcctcccgagtagctgagattacaggcacccaccatcatgcccagctaattttttgtatttttgtagagacagggtatcaccatgttggccaggctggtcttgaactcctgacctcaggtactccgcccacctcagcctcccaaagtgctgggattacaggtgtgagccaccacgcctggcctgtttgacctttataagatcaatttttttgttcacaagcatttctttactcatagataccatttttataacttatatgagacgcatttaatgtaatcatattactttcttatattagaagataggatttcttctgatgtatcgaagttactttatacttcatatgaagtcattaggaggtgaattattgccaattcaatgaattatttatgagtattaggggaatgtttttgttatgctgcttttaatttggaaagcagcatatcactcaaactatagtaattcacatttttccatttaactaaaaatgtctcgtaactactatgccacaagaacaagcatggatacttatttaaccagccaagactatgcatttctaaatatttatttttttcggttatccgtagacttttccttttgaaatccaacgatctgtatcaaccacgtcttcattttccttttcctgtttgtcttactctccccccaaaaagagtcagtttcctgttttctcaatttctcagtttaaaattagagccctatggcaggtgccatgtacagctgcaaaggtggcaagaagccctgagaaagctcaagaagcaggtcaagggggtgggtaaggaagatgggacgttcaagcagaaacaaaaagaggagctaaaagtgaaagccaccccgccaccagccctcaccagtcacaggtggaattaaagaaatctggcaaaaaataaattttgttatccgtgcttggggcggtgacccttgaccccattcctatttaaacatctggattctctgccataacatcttttgccacctatagctacaataaagtgtcgtcttggagtctgttgtacatttaagaataaacttttgtaaggaagtaaaaaagagtctacagttcagtgcaggatagggatgggtgggccttaattcaggaggtgggaggctcaaaatcaattactctgttgaggagatggaatctcctggaatctcaaaaaggatttcctttaggaatcatcagactcatccgactcgtcaagtctttctctgcttggagttttgttttgtttttattttgttttgttttggagataggttctccctctgtcacccaggctggagtgcagtggtgcaatcacagctcactgcagcctcgaattcctaggctcaagtgatcctcccacctcagcctcctgagtagctgggactacaggtgtgcaccaacaggcccagataattttattttttgtagagacggggtcttgctatgttgccaggctggtctccaactcctggcctcaagtgatcctcttgctctgcctcccgaagtgctaaaattacagctgtgaaacaccgcgcctggagtttaaaagcaagattaacctttttggactggagttcttagagaattatggtgtgactcattgaccatatttgttaggatcagcatttttatatgatttaacacaaaatgttacagaaaaaagtgcaaaaatgttgtaaggcacagttggtttcctaagcaaatgcccattcctattctttgttcatctccactctagaggctagaaatactaaattctctttttacctcgttgccttgtagagggatgatcatatgacatttcaccaatggcacataattcaaagtctgctgaggatttctagggtatcctgattaaaagggacagatgtggctggtagtgtctattaccacctccttcctgccttaaatgtagctgcggatgtctagaattgtgctaatcagcttatgactataaaagagaggtgaagagagccagatctgaaagtggtgagccgaccaggcacagtggcacacctgtaaccccagcactttgggaggccgagggaggaggatcatttgagcccaggagtttgagaccagcctgggcaacattgcaaaacctgttctctgtgaataacttaaaaattagtcaggtggccaggcgtagtggttcacacctgcaatctcagcactttggaaggctgaggtgggtggatcacctgaggtcaggagttcgagaccagcctgaccaacatggagaaaccctgtctctactaaaaatacaaaattagctgggcgtagtggcttatgcctgtaaccccagctactcggcaggctgagacaggagaatcgcttgaaccagggaggcagaggttgcagtgagctgagaccacgccattgcactccagcctgggcaacaagagtgaaactccatctcaaaaaaaaaaaaattaggtatattggtgtgcacctgtggtctcagctactcaggaagctgaagcaggaggattgcctgatcctgggaggttgaggctgcagtgagccatgatcatgccactgcactatatgctgggcaacagagggagaccctgtctcaaaaacaaacaaaacaaacaaaaataagcaaaaaaaaaaaagtgttgagcagctaaaacaatgccgttagatgccctatctcttaaaaaaaaaaaaaaaaagataaaataaaagaaattgggtcttgtggccaggtgcggtggctcacgcataatcccaacactttgggaggctgaggtgggtggatcacttgagcccagtagtttgagaccagcctggccaacacgtcttcttgttctagatgaaaagtaaacccctatttggcttactcacttaaaaaaataataataattagagacagggtgttgctatgttgccctggctggtctcactcctgggttcaagtgatcctcctgcctcagcctcccaaagtgctgatattacaggcgtgagcaaccatgccagcctggcttagccacttttaattattactcgtagctgcaagaatgccaatgagcatttggggtaaaaaggggcaagaatggaggacctgctctgtctgtcggactttggaactcaggaagcaacaactaagcgtactcgttgtcttagtccattttgtgttgcatagaacagaatacctgaaactgggtcatttataaagaaaaggaatttatttcttacaatagtggagactgagaagtccaaggtacagggtccacatctggtgagagacttcttgttcctgggaactctctgcagagacccaaggtggcagagggcctcacgtggtgagggacttgagcatggtagctcaggtctctcttcctcttcttataaaggcaccagtctcactgggcagagccttcatgacccagtcaccttttaaaggcgccatctctcaatattgccacattggggatgtttccagatgagttttggaggagacaaatattcaaactacagcactggttaaaaataaaaatagggcctggcgtggtggctcacgcctgtcatcccagcagtttgggaggctgaggcagatggatcacctgaggtcaggagttcgagaccagcctggccaacatggtgaaaccccgtctctactaaaaatataaaaattagccaggcatgctggcgtgtgcctgtaatcccagctgctcaggaggctgaggcaggagaatggcttgaacccgagaggcagaggttgcagtaagctggaatcacactattacactccagcctgggtgacaagagcgaaactctgtctcaaaaaaaaaaaaaaaaaaaaaaaaaaaaaaaggccagacttggtagctaacacctgtaatcccagcactttgggaggccaaggcaggaggatcacttgaggtcaggagttggagaccagcctggccaacatggtgaaaccccgtttctaccaaaaatacaaaaattagccgggcatggtgacgtgtgcctggcagaggtttcagtgagccgagatcatgccattacactccagcctgggtgacaagagcaaaactctgtctcacaaaaaaaaaaaaaaggccaggcatgatgactcacgcctgtaatcccagcgatttgggaggccgaggcaggtggatcacttgaggtcaggagttggagaccagcctggccaacatggtgaaacccaatctctactaaaaatacaaaaattagctggacgtggtggcaggcgcctgtaatcccagctactcactcaggaggctgaggcaggaaactcacatgaaccctggagacgtaggttgcagtgagctgagatcacatcactgcactccagcctgggagacagagtgagactccgtctcaaaaaaaaaaaaagaaaagaaaaattagtcagctgtgatggtgtgcacctgtagtcccagctactctgaaagctaaggcacgagaatcgcttgaacctgggaggcggaggttgcagtgagctgagatcatgccactgcactccagcctggatgacagaatgaaactgtgtctcaaaaagaaaaaaaaaaacaaaaactagtagctagccccacccccgccatttttccagactccagagagtggggtgtgtggaagacagggactggtctggtggcatgtagattcataaatggcgtccaaacctggagctgttgctggcttggaatgaatgaaccagttccagccaggaacagactttcccaccaagtgggaggtggtctacctgcccttcaccatcatctttgtgctctctgacactggtcatcctcagttacccaatatacccctcgccccagccccatccctagtcacccctcattcctagtagtacccccagttctgcttcaatttgattcagcagatcaagaaagcactatcaccaatggtcgcaaggtcatgcttaagtcttggaactggccatcagtgtgaaagttcaacaggtattcagtaagcagatctaggaaaaactcactctaataacgttccaggaatttcctaagaccatagtgggagacagctgcatcagaggcctcccagtgccataggaccatggacattggtgagcaactgtgtgctgggaggaaatggctgcttattggcatggagttattgaatgcagaacttttcagccaagcacagtgctattcttctgaaatcataacatcatgaggacatccactgcttgtactcaaatagcattcctcacaggaatgtcacacctgtgactctctcatacctccaaaatctcactgctgttctgaaacgcaagagattttgccaaggaaatgctgacattccttctgtccactcctctccccacactgcactgtgtggccccagagaggaaagacaagggctgttaccatggagttcttgaatttcattatttatctcccaacacaactttggcctcaccctcttccccagcgtgaagacgcacaacccaagtgggacagtctgaatttccccaccctcaggtgtcagagaatcagaggaagtcatgctgcttatctagaatctgctagaaatggagttcacccaaagaatgaccatcacagaatttatgaactactcctagatcatgcaattaataagtcctctagcccagtaccactcaaggtagggtctgggccccagtaccagtccataaacagtttgctgccggctgggtgtggtggctcatgcctataatcccagcactttgggaggccaaggtgggcggatcacttgagatcaggagtttaagaccagcctggccaacatggtgaatccccgtctctataaaaagtacaaaaattagccaggtatggtggtatgtgcctgtgatcccagctactcgggaggctgaggtgggaggatcacccaagcccagggaggtcgaggctgcaatgagccaccgtgatggtgaactgcactccagcttgagtgacagagtgagatcctgtctcaaaaaaaagggcggggtgcggggattttgggtagtaatatcaatagcagacaaaatagaatttgaggcaaaaagtgttaataggatcaagatttttttttttaaagaacaatccaccacaaacatagcaatcatgaacaacccagaaaacagcatgaaaattaaaaggaaaattgagattttaaatacttctaatagaggtgatagagcaggcagcagggaagttagtaaccttgtctaataggttatctgtactcaacaagcctagaacacacactcctttcaagtacctgaggaatgtttataacagtaaagatgaacagagatcatattataaatagttggaagatttattttttattttgttttttagaaacagggtcttgccggccaggcgtggtgactcatgcctgtaatctcagcactttgcaaggccgaagcgggtggatcacctgaggtcaggagtttgagaccagcctagccaacatggcgaaacctcgtctctactaaaaatacaaaaattagctgggcgtagtagtgggtgcctataatcccagctacttgggaggctgaggcaggagaattgcttgaaccgggagggtagaggttgcagtgaaccatggtcgcaccacttcactccagcctggacaaaagagcaaaactccatctccaaaaaaaaaaaagaaaagaaactgagtcttatggctggatgcagtggctcacgcctgtaatcccagcactttgggaggccaaggtaggtgaatcacttgagcccaggagtttgagaccaacctggccaacatggcgaaactccatctctactaaaaatacaaaagttagttgggcgtggtggtgtgcccctgtaatcccagctactcaggaggctgaggcaggagaattgcttgaacccaggaggtggaggttgcaatgagccactgcactccagactgcattccagcctgggcgacagaacaagactctgtctcaaaaacaaaaacaaaaacaaaaaactaggtctttctctgtggccgacgctggagtgcagtgcctttttgcaggcacaatcatagtgcactgcagccctgaactccttggctcaagtaatcctcctgcctcagcctcctgagtaactgggactataggtatgccctaccatgtgtggctatatttggtaggttttaaatgaaaagatttttgttttctgtacatttatttaaatttaaaaagtatttaagccatctttaagaaacttaatgttgagaatgttctagaatagtgagtcattagatttcaaaatattggtattgaaccagatggtcttgtggcttcaaagaagtctctgaagtcactccaggtgatattaaaagtacagtgctaggactgtctgacccaaaatatgtggctggaaccagaaaggatataagcatggtttgagaaggaaaaaaagcttaacaagggggaattgaggaagccatttgcaaaacttcacaggaaagttaaatgaatgaatgaataaaatgtgattaataaatatgggggccaggtacagtggcctgcatctgtaatcccagtgttttgggaggccaaggcaggaggtgcacttgaggccaggagttcaagacctgagcaacacagcaagacccccgtctctataaaaaattttataaaattagccgggcatggtggtagacacctgtagtcccagctacttgggaagatgaggcagaggattgcctgagcccaggagtttgaggttatagtgagccatgactgtgccactgcactccagcctgggcaacaaagtgagaccctgactctaaaagtaaaattaaattaaattaaaaataagtggataaatatgggttatgctgtgaagcatagagggagggatgaagagggacattttaagccacttctctggccccagtttctaacattatttctaaaatgcaggatatctggttatcccaaaccagttatatttttatttaaatttgctcaaaatttttatttttaaatcttaacaatttctaaaatcacactttttaatttattttgtatttttttgagacagggtcttactttgtcacccaggctggagtgcaggggcacaaacatggctcactgcagcctcgacctcccagcctcaagtgatactcccgcctcagcctcccaagtagctgggactacaggcatgcaccaccacacctggctaatttttttatattttgtttgtagagatggggtttcaccatgttgccctgtctagtcttgaaaccttgagctcaagagatctgcccaccttggcctctcaaagtgctgggattacaggcgtgagccgtcctgcctggcctagtcacacttttttttttttttttttttttggagacagagtttcactcttgttgcccaggctggagtgcaatggcatgatctggactcaccgcaacctccgcctcctgggttcaagcgattctcctgcctcagccacccaagtagctgggattataggcatgcaccactatgcccggctaattttgtatttttagtagagacagggcttctccatgatggtcaggctggtctcgaactcctgacctcaggtgatctgcccgcctcggcctcccagtgttgggattataggcatgagccaccgcgcccagctagtcacgctttttagtcaagatttttaaaaatgtctgcatgcttttctgagagccttacctctcttgtgatttgaagcattttctccaccaggcctaaggctgaaggaatgtagtttgctgcccttcagtctatgacaaggaggtctgtttcctccaacgcctgccttttagacagagtgttgattcacagggaacagaggcagacctggggctgacactgaatgaatgctactcacagcagtaaggggaaaagtgggaaagtcttgtttatgctgtggctgatgtggatgtctttggggaagaaaaattcaggatgagtttattgagagcattatttttgaaagtataagatttgtgattgtaatataaacttaaatcactttgggaatgaatttaaaaaatctatgtgacacaaattaatcatcattctcattgtaaatttggcaaagtatttgtaattaggaatatctgtcatactggcactgggcaaattattctgaatgttcccatgctgaagattctctcaaaaagggaaaaaacaagatcctttgtttgtataagtacaatcagtttgctgaataaaacctttatagctacaattataacaggattgtttctacattttagcttggagatcccatgactactctgttttgctaataataaaccaatacagtgctac

SEQ ID NO: 183861 - DNA, 726 bp, Homo sapiens
  Payload ID: 16227
  Gene Symbol: SLC35E3
  Gene Name: solute carrier family 35, member E3
  ENST ID: ENST00000431174
  CDS Start-End: 1-378
caggctccgatgtcatctgccatgttgctggttgctgtgcccttctttgagccagtgtttggagaaggaggaatatttggtccctggtcagtttctgctttgtcgaccaggctggaatgcagtggcacaatcatggctcactgcagcctcagcctcctgggctcaagcaatcctcctgcctcaacctccccagtagctgggactacaggtgcacaccaacatacctggctgatttttatattttttgtagagacagagttttgccatgttgctcaggctgatctcaaactcttgagctcaagccatctgtctgcctcagcctctcgaagtgctgggattacaggcctgagccaccacacctggccagtaatttcttaatcctacctccctgcttctattgcctagcccgtacatttgaggcttccatggagctttctgtggtactgaaacacttggagtgaactgcaaacttggagtgaactacatccaacctttctaaggtggctggggaaaattcttgtacagcaagttgggacaaaatagccatatagaaacagccatataagatcccaatatagaaaaattgggatattagaggaaatacatgatttccatttatggagtgctacatgtttgcaaaatgtatttctgcttttcatcttcttgacatctgaatattaaaagcagttgttgataatttcatataataaattgagacatatcatt

SEQ ID NO: 183862 - DNA, 2714 bp, Homo sapiens
  Payload ID: 16228
  Gene Symbol: SLC35E4
  Gene Name: solute carrier family 35, member E4
  Uniprot ID: Q6ICL7
  ENST ID: ENST00000343605
  CDS Start-End: 800-1852
gggcttggctggggtgctcagcccaattttccgtgtagggagcgggcggcggcgggggaggcagaggcggaggcggagtcaagagcgcaccgccgcgcccgccgtgccgggcctgagctggagccgggcgtgagtcgcagcaggagccgcagccggagtcacagccgcagccagagccgcagccaaagcctcagagagcaggagttggagcgcaggccctgctggatccgcgcctagctcgccgccaggcaccggccggaggacgggccgtggtgtcagctcactgcccgggcgctgtgggaggcagcgagcccgcgaccccccgggccgggcaccgccaggcgcggagcccagatcgcccccctgccaggcctggtcacggccagagcacgcaggagttcccagggtctggatctgcgcgcaccctaatgacctggggactgaagagaaaaaaggaacgaggatttcatctaaaagcataacgtgggcactaggcgaggaggaaagtggagaccacctggcacggggcagaggtgcctggagcccacgcttgagcatcggagaccctggcatcctagcagccgcgaccttggctctgccctgtctgagctggaaacacagcttagcttctagacatcgctggcacaggcctggcacaagtaagcagtgtcctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagtgccctgctgcaggaggagaggctggacgcggtgaccctgctttacgccacctcgctgcccagcttctgcctgctggcgggtgcagccctggtgctggaggctggcgttgccccaccgcccactgctggcgactctcgcctctgggcctgcatcctgctcagctgcctcctgtctgttctctataacctggccagcttctccctgctggccctcacctctgccctcaccgtccacgtcctgggcaacctcaccgtggtgggcaacctcatcctgtcccggctgttgtttggcagccgcctcagtgccctcagctacgtgggcatcgcactcactctttcaggaatgttcctttaccacaactgcgagttcgtggcctcctgggctgcccgtcgggggctgtggcggagggaccagcccagcaagggtctttgagacctgggggatctcaggagccacctgggatggccctggcctgaatccagcctccgctgtggccatagaaggaatggagaacagggctgggcatggtggctcacgcctataatcccagcacttccagagtccgaggtgggtggatcacctgaggccaggagttcgagaccagcctggctaacatggcaaaacctcatctctactaaaaatagaaaaattagctgggcatggtggcgcgtgcctatagtcccagctacatgggaggctaaggtgggaggatcacttgagccctggagatcgaggctgcagtaagccaagatcgcatgctactgcactccagcctgggagacagagcgagacgctgtctcaattaaaaaaaaaaaaaagtggagaactggcagtgacctctactgggggccatggcagggaggggagccttctggaagggctgccttggagattggaatggggactcccagggagacctgcgttccatccctgcctgcctcacccctgccacagactctgcacaccactggatggtgggtccaagcctggcacagtccctgtgcttgtcagagtcattattatgattaatatcaattacgatgccaaaaattgctgggcaaactttgaagacctcaacttgttacaatgacgatgatgatgattcttggcggttacacaatccttcctcctgggggggaggcagctaggaggcccagcaggggggcttctatgctgctgggctcccctagggagttggggtagtctgtgccaactccaggcagctgctgtggcctcacccctgggccccccaattttgggtcatccatcctcaaatacactatttttgcttgta

SEQ ID NO: 183863 - DNA, 2081 bp, Homo sapiens
  Payload ID: 16228
  Gene Symbol: SLC35E4
  Gene Name: solute carrier family 35, member E4
  Uniprot ID: Q6ICL7
  ENST ID: ENST00000406566
  CDS Start-End: 129-833
ctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagcctcagcttccagatctgcaaaatggaactgatgatccctatggagagggttcgaatgaggagcgctgggcagggccaggagtgaggaaggagggtaactttttggaagagtactttgtaacaataaagtgctgtgcacagaaaggagaaatgccattatggggatgtgtgtgccgacctgggaccagcagggtgaaagagtctatcattcatgatgagagctgccatttgcgctaagcacacaccatgtgccaggcactatgccaagaaattgttgaatcttcacaataactctgtgagaaaagggctgtcattggacagatgaggacactgatgctcccaggggtccacatcacatgaagaggaggtgacagggctgggccttggtccgaagctccagccttccaagccaaggcctgtgagaggaaccgctgagacctgatgttaggcctgtttttctcatgtgccctggagaaggggactaacaccatcttttgccaaagtttggtgagggatggccaagagctctttgaaactttgccatgtacaatagcactcacaattttttttaaattttttatacagtggtatcggggtacagtggctcatcaacactttgggaggctgaggcgtgaggattgcttgaggccaggagtttgagaccagtctgggcgacatagtaaaatctcatctctataaaaaaagaaaaaaaatgaggcgggcatggtggcaaacatctgtagtcccagccacgcaggaggctaaggtaagaggatcacttgagcctgagaggttgtggctacagtgagccatgatcacactactgcactctaggatgggtgacagagcaggacagtttcaaaaaaagacaaaaaaaaatttacacagtggaatgctttctttaaaaactatcttatgcataagtacaatctagaaaaccagaactgggccacttatagtgaaggtggaagcagaggtggcctgggaccccccaggattcctggagcactgcctgaaggccatttatctagtagattggcactcactgtaagaagcgcaagaggtaccatgatgcttaaggctctggctctgggtgtgaaagaatgaggtggaattgtagcagattcattcctgggtcaatctgtttttggggagggctgcaggattccaggcctgccatgtgcaatgggtgctgccctctttcttctgggcaccatctgcctcaacctatcccctggccagtgtcactcacagggcagaaaatttatcttcaccatctcacaattagtttaatcttaaaaaaaatggattataaagttaaaagctacagcaa

SEQ ID NO: 183864 - DNA, 2030 bp, Homo sapiens
  Payload ID: 16228
  Gene Symbol: SLC35E4
  Gene Name: solute carrier family 35, member E4
  ENST ID: ENST00000451479
  CDS Start-End: 1-612
gctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaaatcctgatctggtccattcagcagaggactgcagaagtctgaggagccttaagatatcaacttaaagcaatgggctcgtcgcagaaaggaatagcctgtgccgggtcttcagagaaatcctggcctcggctccacgcccctgagcagccccaccctggctcaacctgttacccgccctgccggcaagccggggtcactgcagtccccgtggcgaagcagggtcagctcagctcaccgcaccccactccatccagccctgcccatctctacggcaacgggccgggtcgcaccagggctgcagccgagagacagtctcaccgcttccgtagccgcccgggctctgtgcgcatgtgcgacactccctccccggccccgcccccttatgcgtctcccaggcaacgcgccgcgcggggctccaggttccgcccagggactaactccaggtctgcgcgcgtccaacgagcacggctctcaaccggcctcctggcgcccaacgaccatggcttccaaccggcctccgtgcgcccaacgaccatgactcccaaccggcctccagtttccaactgtttctcgaacagggaagccgccatgacacagctgactacgcccttggtcacaggggacctgagatcctccacgatttacgggaccggcgccacctcgggctcgaaccaccctctcgatagggccgccgctaagtaatcggcgtaggggttcagccgcacatctccttcccgcgccgcggaccgagcagtcgttggtgctcttcaggtgcggcctgggtgcccagagccttcgttagactctcggacccgcaagggagcccgaactctttcagactcgctctccctcagccggacctcggccctttttcacaccccaggggagtctggatttctcatagtcctgggcaccagccccttcccagtctagctcttgggactccctgaagccggaactccctcgcctggactcccgggagaacctggaatccccatctccagtccacattttctcagaatctgtcctagcccttcagtctcccaggcatgacatcgtgtggtcccagcgccctaggtggtgagctgtgactctccttagagcctggcgaggccgaggtcctccccagctcgaacccatcccacactccccttctcagcctctgtgttccccagtggtcctggaaaagcccccagttccctctgcctggccccaatcctcacaaacccaattacccacgctcctttccattccataacccccatcactgcatcctccaggctcccatccatggaggacttgaggtggaaagcaatttggttcaaaataaccattatttattacttgaaagggaatatttccagtcgttgccagcctcctccccttctagtattggtaaattttttgcaccactgagtgggtgaagagttttatgcgtctttaaatgttttaaggatttttttaaaaaaacaaaaaactctca

SEQ ID NO: 183865 - DNA, 4852 bp, Homo sapiens
  Payload ID: 16229
  Gene Symbol: SLC35F1
  Gene Name: solute carrier family 35, member F1
  Uniprot ID: Q5T1Q4
  ENST ID: ENST00000360388
  CDS Start-End: 202-1428
gggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatggtcctctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattcttttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaa

SEQ ID NO: 183866 - DNA, 4481 bp, Homo sapiens
  Payload ID: 16229
  Gene Symbol: SLC35F1
  Gene Name: solute carrier family 35, member F1
  Uniprot ID: Q5T1Q4
  ENST ID: ENST00000621341
  CDS Start-End: 8-1057
cagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatggtcctctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattcttttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaa

SEQ ID NO: 183867 - DNA, 1076 bp, Homo sapiens
  Payload ID: 16230
  Gene Symbol: SLC35F2
  Gene Name: solute carrier family 35, member F2
  Uniprot ID: Q8IXU6
  ENST ID: ENST00000375682
  CDS Start-End: 93-1076
agcagggaggcagaggtggcggccgcacggacttcggttcggggctcaacacgcacaccaggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtag

SEQ ID NO: 183868 - DNA, 562 bp, Homo sapiens
  Payload ID: 16230
  Gene Symbol: SLC35F2
  Gene Name: solute carrier family 35, member F2
  ENST ID: ENST00000524991
  CDS Start-End: 33-143
gttttgggcgccggagacgcgcaagggcgccgatggaggcagactcgccagcgggccccggcgccccagagcccctcgcggagggagcggcggccgagttctccagcctgctgcgcaggataaaaggcaaactcttcacctgaatcatggagggttacgctgccaaaccacagagagaccagagaagcagcaggagccaggagtccaaaccacagcaggattctgtgaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgat

SEQ ID NO: 183869 - DNA, 1028 bp, Homo sapiens
  Payload ID: 16230
  Gene Symbol: SLC35F2
  Gene Name: solute carrier family 35, member F2
  ENST ID: ENST00000532513
  CDS Start-End: 1-798
atggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctga

SEQ ID NO: 183870 - DNA, 1007 bp, Homo sapiens
  Payload ID: 16230
  Gene Symbol: SLC35F2
  Gene Name: solute carrier family 35, member F2
  ENST ID: ENST00000533664
  CDS Start-End: 42-158
acttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgca

SEQ ID NO: 183871 - DNA, 3331 bp, Homo sapiens
  Payload ID: 16230
  Gene Symbol: SLC35F2
  Gene Name: solute carrier family 35, member F2
  Uniprot ID: Q8IXU6
  ENST ID: ENST00000525071
  CDS Start-End: 590-1663
aaatcactctccctcaacgctcactgggcgccggcaggaaagtgggcgtggcgggaagacgtgacagcagcaacaaccaaggaaaatgaagcaaggtctcaactccgggagggtcagccaatgaaaactcactgataaccttgttgagccggtcgtaatcctcctcgatgcccacgctgtccaagatcttcttgatgtccttggcgctgggggaggagttacccccgagggcagccagcagcccgtggaagcctcggaaggcgtggccagggcagggcatccaagccgagcgccgggggttggcaccgtctctctccctggcacggcggagacaactgaatactgaaagacaaaaccaacacaccgcgaggaatgagccacgcctccatccacgccacaaagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaataca

SEQ ID NO: 183872 - DNA, 3170 bp, Homo sapiens
  Payload ID: 16230
  Gene Symbol: SLC35F2
  Gene Name: solute carrier family 35, member F2
  Uniprot ID: Q8IXU6
  ENST ID: ENST00000525815
  CDS Start-End: 422-1546
actgcttctaactcactgctcactcaccgcttcttagcttaggaatcacctacaataacctcgtgtcactgtatcttgtgatttcaaacaaggaaccctaaaaacctgaaggcacactgggtgccgctcaacaataaggctcggctgccaagacgaaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaataca

SEQ ID NO: 183873 - DNA, 2762 bp, Homo sapiens
  Payload ID: 16231
  Gene Symbol: SLC35F3
  Gene Name: solute carrier family 35, member F3
  Uniprot ID: Q8IY50
  ENST ID: ENST00000366617
  CDS Start-End: 229-1494
ggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggggaggagcgcccccgggactccccgggcccggcggaggcccaggcaccggccggggtggaggccggcgggagagcgagtcgccgctgctggacgtgctcccgggcgcaactcaagaagatcttctggggcgtggcggtcgtgctgtgcgtgtgctcctcgtgggcgggctccacgcagctcgccaagctgaccttcaggaagttcgacgcgcccttcaccctcacgtggtttgccaccaactggaactttttattcttcccgttgtactacgtggggcacgtctgcaagtccacagagaagcagtctgtgaagcagcgatacagggaatgctgtcgattttttggagacaatggcttgactttgaaggtgttttttaccaaggcagcaccctttggtgttctttggacactcacaaactacctgtacttacatgcaataaagaaaataaacactacggatgtctccgtgttgttctgctgcaacaaagcttttgtgttcttgctctcatggatcgttctcagggacagattcatgggagtgaggattgtggccgccatcctcgccatcgctggcattgtgatgatgacctacgctgatggcttccacagccactccgtcatcggcatcgcactggtggtggcctcagcatcgatgtctgccctctacaaggttttgttcaagctcctcctgggcagtgctaagtttggagaagccgccttatttttgtccatcttgggtgtgtttaacatcctcttcatcacctgcattcctattatcctctactttaccaaagtggaatactggagctcttttgatgacattccatggggaaacctttgtggattttcagttcttttattgacattcaatattgtattaaattttggaattgccgttacatatcccactctgatgtctcttggaatcgtcctcagcatacctgtgaatgcagtgattgatcactacaccagtcagatcgtcttcaatggggtccgggtcatcgccatcatcatcatcggcctgggttttctcctcctgctcctgccagaggagtgggatgtctggttgatcaagctgctcacccgactcaaagtgaggaagaaggaggagcctgcagagggcgctgccgacctgagctcaggacctcagagcaagaacagaagagcccgcccttccttcgcccgctaacaccactcctctagaactcggtggtaatgactgggaggtctattcctgccgggaggaacctcagttgggtaaggtgtacatacctgtacagttttggtcatctgcggtaagttctatggtatttattggcatgtccaatttgcttgcacttttccacatcagaccttccacttaagggtaccaattcaatacaaaagagaaaagaagaacctctcagtgcttttccaacgaatgtaaagtgggtttaaaagttccctgcgtagatcgttttggatggctgacgttcttgacaagccagccatcagggcaagtgttttgaatcttagcaagtgttttgaatcttagcaactgaacatgacattgcacactgtgattatttttcagctatggtaggtcatattttgttttataccagagctgtactcttaattttaaggaatttcaatgaaccaaaagataactgtcaatttatttggatggatggatggagggatggaaggagggagggaaggatgtctgggatgtgaagaggcaaggcagaaatggatgatgaacatcaaaaactgtcagaggacaggtctgtgccaggtaccaggaaggacaagataagtccaagccccggctggcctgctctcacgtgtctgtgtaagatcatgcaagagaaatcacagtgccttctacagaattttcgtctttacctatgtgaagcgaggtgacgtgatacgtcactggcgccgtcttataatttagatgtaaaaatctttagaaacaaataaaactctctatatatgtgtatgtctgtgtacaaaaaaatgacagagctgatggccagtgtatacagagcgtggcccgcggtgtacaatacccatataaggtacattgtgcaggaggggaattgctggctgcttttacttcctgaccaagactgaaaaattatttactgaaatctgtaaacctttttatgaaacttttaagcaccaggctgtttacttacacaatttaggtctgccagaaaattctatctgtgatagatctgtaaagagggtcaggggttagagtttactatttttgaagtttacattgttacatatgaaatggaaacattattttgaaacgttgtcataacccaatggtgcattctgtaaccatggagtcttctgtttcctgggggaaaggggcattcatgacctgaactttttagcaaattattattctcagtttccattacctgtttggccaaacagattaataaaatatttgaaaaagaa

SEQ ID NO: 183874 - DNA, 2891 bp, Homo sapiens
  Payload ID: 16231
  Gene Symbol: SLC35F3
  Gene Name: solute carrier family 35, member F3
  Uniprot ID: Q8IY50
  ENST ID: ENST00000366618
  CDS Start-End: 146-1618
aaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgttggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcgcatcactggctactatggctaccagccctgggcagcgagctgcaaaagggaggagcgcccccgggactccccgggcccggcggaggcccaggcaccggccggggtggaggccggcgggagagcgagtcgccgctgctggacgtgctcccgggcgcaactcaagaagatcttctggggcgtggcggtcgtgctgtgcgtgtgctcctcgtgggcgggctccacgcagctcgccaagctgaccttcaggaagttcgacgcgcccttcaccctcacgtggtttgccaccaactggaactttttattcttcccgttgtactacgtggggcacgtctgcaagtccacagagaagcagtctgtgaagcagcgatacagggaatgctgtcgattttttggagacaatggcttgactttgaaggtgttttttaccaaggcagcaccctttggtgttctttggacactcacaaactacctgtacttacatgcaataaagaaaataaacactacggatgtctccgtgttgttctgctgcaacaaagcttttgtgttcttgctctcatggatcgttctcagggacagattcatgggagtgaggattgtggccgccatcctcgccatcgctggcattgtgatgatgacctacgctgatggcttccacagccactccgtcatcggcatcgcactggtggtggcctcagcatcgatgtctgccctctacaaggttttgttcaagctcctcctgggcagtgctaagtttggagaagccgccttatttttgtccatcttgggtgtgtttaacatcctcttcatcacctgcattcctattatcctctactttaccaaagtggaatactggagctcttttgatgacattccatggggaaacctttgtggattttcagttcttttattgacattcaatattgtattaaattttggaattgccgttacatatcccactctgatgtctcttggaatcgtcctcagcatacctgtgaatgcagtgattgatcactacaccagtcagatcgtcttcaatggggtccgggtcatcgccatcatcatcatcggcctgggttttctcctcctgctcctgccagaggagtgggatgtctggttgatcaagctgctcacccgactcaaagtgaggaagaaggaggagcctgcagagggcgctgccgacctgagctcaggacctcagagcaagaacagaagagcccgcccttccttcgcccgctaacaccactcctctagaactcggtggtaatgactgggaggtctattcctgccgggaggaacctcagttgggtaaggtgtacatacctgtacagttttggtcatctgcggtaagttctatggtatttattggcatgtccaatttgcttgcacttttccacatcagaccttccacttaagggtaccaattcaatacaaaagagaaaagaagaacctctcagtgcttttccaacgaatgtaaagtgggtttaaaagttccctgcgtagatcgttttggatggctgacgttcttgacaagccagccatcagggcaagtgttttgaatcttagcaagtgttttgaatcttagcaactgaacatgacattgcacactgtgattatttttcagctatggtaggtcatattttgttttataccagagctgtactcttaattttaaggaatttcaatgaaccaaaagataactgtcaatttatttggatggatggatggagggatggaaggagggagggaaggatgtctgggatgtgaagaggcaaggcagaaatggatgatgaacatcaaaaactgtcagaggacaggtctgtgccaggtaccaggaaggacaagataagtccaagccccggctggcctgctctcacgtgtctgtgtaagatcatgcaagagaaatcacagtgccttctacagaattttcgtctttacctatgtgaagcgaggtgacgtgatacgtcactggcgccgtcttataatttagatgtaaaaatctttagaaacaaataaaactctctatatatgtgtatgtctgtgtacaaaaaaatgacagagctgatggccagtgtatacagagcgtggcccgcggtgtacaatacccatataaggtacattgtgcaggaggggaattgctggctgcttttacttcctgaccaagactgaaaaattatttactgaaatctgtaaacctttttatgaaacttttaagcaccaggctgtttacttacacaatttaggtctgccagaaaattctatctgtgatagatctgtaaagagggtcaggggttagagtttactatttttgaagtttacattgttacatatgaaatggaaacattattttgaaacgttgtcataacccaatggtgcattctgtaaccatggagtcttctgtttcctgggggaaaggggcattcatgacctgaactttttagcaaattattattctcagtttccattacctgtttggccaaacagattaataaaatatttgaaaaagaagcgtt

SEQ ID NO: 183875 - DNA, 1779 bp, Homo sapiens
  Payload ID: 16232
  Gene Symbol: SLC35F4
  Gene Name: solute carrier family 35, member F4
  Uniprot ID: A4IF30
  ENST ID: ENST00000339762
  CDS Start-End: 1-1566
atggatgaactactcttggatctcttccacaaactgaccagtgggaggcagctggcagcaggcaatgggctttgcggtatatcacataaggaacaggaggtatggaagccaggacataatattttagtgaaaatgagaaaggaagataaatcactggtgtggcttatacattcaacacttgctcgctacacacaagttaccaactttttaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 183876 - DNA, 2700 bp, Homo sapiens
  Payload ID: 16232
  Gene Symbol: SLC35F4
  Gene Name: solute carrier family 35, member F4
  ENST ID: ENST00000557254
  CDS Start-End: 1430-1885
atggatgaactactcttggatctcttccacaaactgaccagtgggaggcagctggcagcaggcaatgggctttgcggtatatcacataaggaacaggaggtatggaagccaggacataatattttagtgaaaatgagaaaggaagataaatcactggtgtggcttatacattcaacacttgctcgctacacacaagttaccaactttttaggtaactatggacaatatttgatctcaatcccatcccaacttgctacccagcctatttctagactttctccttttgatgtataattgccaagggattggaaatggaatattgggaaaatgaaacccaatattaccctgagaaaagaggagaaggcataccttataaaaataaatttcaaaagataaattttaaaagactcttggagtatctgagcatcagccactcttgaagaacaggaataattgtgagttcactgaatttcagacagtccgtttttatcgaacttgaattgtccaattagaaacatagctgtacaaggtataataaacattctgaatatgtaaaataagaaccctgggtatttttgatgctcttataataacaatagtaacatagcattaatttaagtgtagcagtcagtatataatgcttctgttaactttctgagtaactgtaaatttttaattttctaaatccaagattacatagtacattttattttatttgtatgggtgcatagtaggtatatatatttacaggtacaggagatatttttatacagacataccatgtgtaacatgtcatctatcacctcaagcatttatcatttctttgtgttacaaacatttcaattatgatcttagttattttacaatctacaatcaattattgttgactgtagtcaccctcttgtgctttcaaatattagatcttactcattctaactatatgtttgtactcattaactgtccccactccctccaccctcaacccactatccatcctaggttctggcaaccatcattccaaagaaatagaagaaatagaaatgcttggagaagtgattaatttcaggagtggggcagggaaactataagacaagcccagggcatcttgcagtgccagaaagtaaggaagagctcaaacgcaaaagaatggggacaaatcaaaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggattgctgggaagccctgaagatttaaggagccagatctcattcatataatccggcatgccactatgatgaacatattgagacaacacttctttagaaggagatataccagcaataaaatccgttgtattaaagcaaatgagcacatttaactcatggacctcactgatgcaagaggttacgtccaaaaagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggc

SEQ ID NO: 183877 - DNA, 1608 bp, Homo sapiens
  Payload ID: 16232
  Gene Symbol: SLC35F4
  Gene Name: solute carrier family 35, member F4
  Uniprot ID: A4IF30
  ENST ID: ENST00000554729
  CDS Start-End: 363-1451
atggatgaactactcttggatctcttccacaaactgaccagtgggaggcagctggcagcaggcaatgggctttgcggtatatcacataaggaacaggaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatc

SEQ ID NO: 183878 - DNA, 1908 bp, Homo sapiens
  Payload ID: 16232
  Gene Symbol: SLC35F4
  Gene Name: solute carrier family 35, member F4
  ENST ID: ENST00000556826
  CDS Start-End: 238-1695
gggagagctgccaggctgacggagaggccggcccgagtgggggccgctccgccgccgccgccgccgccgccgctgtgatgcggagccggtgctgcgccgggcggtggagtcagagcccgggcgcgggagcaggagctgcaagatcagcaccagcggctccggcacctgcaccagctcccgggccccgcgctgcgctctccgccccgccgcactcggggccgtcgccccgcgctctctatggatgtcaaggcggcccccaacggggtggccactatcgaggaccggatcctgcggatcaccggctactatggctattatccaggttactccagccagaaaagtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 183879 - DNA, 467 bp, Homo sapiens
  Payload ID: 16232
  Gene Symbol: SLC35F4
  Gene Name: solute carrier family 35, member F4
  ENST ID: ENST00000556306
  CDS Start-End: 1-140
tttatttactggctttaaagaagctgacggccacggatgtctccgctctgttctgttgtaacaaagcctttgtcttcttgctgtcatggattgtgctgaaagacaggttcatgggagtgaggattgctgggaagccctgaagatttaaggagccagatctcattcatataatccggcatgccactatgatgaacatattgagacaacacttctttagaaggagatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttca

SEQ ID NO: 183880 - DNA, 4412 bp, Homo sapiens
  Payload ID: 16233
  Gene Symbol: SLC35F5
  Gene Name: solute carrier family 35, member F5
  Uniprot ID: Q8WV83
  ENST ID: ENST00000245680
  CDS Start-End: 415-1986
cgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagcccaaagtggcaaaaacagctcttttctcatttggcaccaccaataacgcaagttaaaaataatgttgagtttattatacttttgacctgtttagctcaacagggtgaaggcatgtaaagaatgtggacttctgaggaattttcttttaaaaagaacataatgaagtaacattttaattactcaaggactacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgcttttctgtttcttaaaaaacaaaaatcaatgaacaacttcttcagaaggaagcaccactgttcaattggttaactgaaagtatgaatcactgccgctttgcttgcccacctgtttgctttttctcacaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatct

SEQ ID NO: 183881 - DNA, 3120 bp, Homo sapiens
  Payload ID: 16233
  Gene Symbol: SLC35F5
  Gene Name: solute carrier family 35, member F5
  ENST ID: ENST00000409106
  CDS Start-End: 818-2371
gggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggtaggcaggcagggaagggccccgacatcaccggagcccaaaccgggacggagtgcccaccagcagcaccacctcctgccctcggtggcagcaggagcgccttgaccgaaaccgtgaaggtctctaggggcggagggagcgggagctgacaggggcgccggagccctgcgcccaccgctggcaattgaggaagccgtgcgtgcgccctcgcctcggctccccggggaggcgtcgctgccttaactgtcttccccgctccaaaacagaaggatgatttcttttcccagctgtttcttttaaaatgactggatgttttgatagaggtgggtggaggagcatggagaatccttttcttttaccacttgaagagattggaaaggtgccttcaagacccacagcaaatcacttactctccgataaccaaattccactccagcagatcagggacagaaaagacacttttagaaacagtgtctagacgctgtccccagggatggattcctctggatggagaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctgcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtcta

SEQ ID NO: 183882 - DNA, 2284 bp, Homo sapiens
  Payload ID: 16233
  Gene Symbol: SLC35F5
  Gene Name: solute carrier family 35, member F5
  ENST ID: ENST00000409342
  CDS Start-End: 745-1491
atagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggtaggcaggcagggaagggccccgacatcaccggagcccaaaccgggacggagtgcccaccagcagcaccacctcctgccctcggtggcagcaggagcgccttgaccgaaaccgtgaaggtctctaggggcggagggagcgggagctgacaggggcgccggagccctgcgcccaccgctggcaattgaggaagccgtgcgtgcgccctcgcctcggctccccggggaggcgtcgctgccttaactgtcttccccgctccaaaacagaaggatgatttcttttcccagctgtttcttttaaaatgactggatgttttgatagaggtgggtggaggagcatggagaatccttttcttttaccacttgaagagattggaaaggtgccttcaagacccacagcaaatcacttactctccgataaccaaattccactccagcagatcagggacagaaaagacacttttagaaacagtgtctagacgctgtccccagggatggattcctctggatggagaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtggtaggtcttttatgatatgtttgcatatgatgtttgaaacttgaattttaagactgtatacataccaacaatataggattgaagtgtgagacaattaggttgtttaatcatgactttaaactctgctatttgataccggtaggaagttagggtatcaaaattaataaatgcttgatatacctcaaagagttagaattcattaagtcctataacacttcagctatttacatatatacacaaacttacaaacacacacaggttgggaagttcttcagaatttagcattgcctcatgctcaaaattatgaatagagttattttacactgtgatatatgtatatacaaaggctagtaaatatccagataagagtttactgtatgcattgatttttttcaaataagtgttttgcagttttatattcatataaatgaggttaagtattattttgtcaagtactcagtatatttctacagaatttctggttgtattatttatagtttctttttaaagatagaaactgaaaactgtgcttaagatttcacatagaataatgatggagtaaataaagtattgttattttgggctaagctgggattagagacttgtctgagttagaactctaacatgtagaatttaaaaaatgaatttctgtgatattttatgtgtacatcattggaagtagcctaatccaaggttttttaaatatgagcctttaagattcaaatttgtactgagcatcttaaacccctaaacaatgaaatgctaatgtcaatgttattagcctgattataaaatttttttaatgtca

SEQ ID NO: 183883 - DNA, 725 bp, Homo sapiens
  Payload ID: 16233
  Gene Symbol: SLC35F5
  Gene Name: solute carrier family 35, member F5
  ENST ID: ENST00000447673
  CDS Start-End: 1-725
gtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagacttgataaagaaggaaatggatataaaatattgaacttcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctg

SEQ ID NO: 183884 - DNA, 736 bp, Homo sapiens
  Payload ID: 16233
  Gene Symbol: SLC35F5
  Gene Name: solute carrier family 35, member F5
  ENST ID: ENST00000420066
  CDS Start-End: 1-116
ctctcctatgccattataataattgggatcctgtgatggtgggaatcagaagaatatttgcttttatatgcagaaaacatcgaattcagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttga

SEQ ID NO: 183885 - DNA, 3898 bp, Homo sapiens
  Payload ID: 16234
  Gene Symbol: SLC35F6
  Gene Name: solute carrier family 35, member F6
  Uniprot ID: Q8N357
  ENST ID: ENST00000344420
  CDS Start-End: 63-1178
aggagaccccgggtgacggggcccggcgccgctaactggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccaggcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaattgtattaatccattctcgaattgctgtaaagaaatacctgagactgggtaatttaatttataaagaaaagaggtttaattggc

SEQ ID NO: 183886 - DNA, 3605 bp, Homo sapiens
  Payload ID: 16234
  Gene Symbol: SLC35F6
  Gene Name: solute carrier family 35, member F6
  ENST ID: ENST00000414029
  CDS Start-End: 26-181
ggagcgaaccccagcgtccgccgacatggcctggaccaagtaccagctgttcctggccgggctcatgcttgttaccggctccatcaacacgctctcggcaaaatgggcggacaatttcatggccgagggctgtggagggagcaaggagcacagcttccagcatcccttcctccagctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaattggcaa

SEQ ID NO: 183887 - DNA, 3738 bp, Homo sapiens
  Payload ID: 16234
  Gene Symbol: SLC35F6
  Gene Name: solute carrier family 35, member F6
  ENST ID: ENST00000429494
  CDS Start-End: 67-234
gcgcaggagaccccgggtgacggggcccggcgccgctaactggagcgaaccccagcgtccgccgacatggcctggaccaagtaccagctgttcctggccgggctcatgcttgttaccggctccatcaacacgctctcggcaaagcagtgggcatgttcctgggagaattctcctgcctggctgccttctacctcctccgatgcagagctgcagggcaatcagactccagcgtagacccccagcagcccttcaaccctcttcttttcctgcccccagcgctctgtgacatgacagggaccagcctcatgtatgtggctctgaacatgaccagtgcctccagcttccagatgctgcggggtgcagtgatcatattcactggcctgttctcggtggccttcctgggccggaggctggtgctgagccagtggctgggcatcctagccaccatcgcggggctggtggtcgtgggcctggctgacctcctgagcaagcacgacagtcagcacaagctcagcgaagtgatcacaggggacctgttgatcatcatggcccagatcatcgttgccatccagatggtgctagaggagaagttcgtctacaaacacaatgtgcacccactgcgggcagttggcactgagggcctctttggctttgtgatcctctccctgctgctggtgcccatgtactacatccccgccggctccttcagcggaaaccctcgtgggacactggaggatgcattggacgccttctgccaggtgggccagcagccgctcattgccgtggcactgctgggcaacatcagcagcattgccttcttcaacttcgcaggcatcagcgtcaccaaggaactgagcgccaccacccgcatggtgttggacagcttgcgcaccgttgtcatctgggcactgagcctggcactgggctgggaggccttccatgcactgcagatccttggcttcctcatactccttataggcactgccctctacaatgggctacaccgtccgctgctgggccgcctgtccaggggccggcccctggcagaggagagcgagcaggagagactgctgggtggcacccgcactcccatcaatgatgccagctgaggttccctggaggcttctactgccacccgggtgctccttctccctgagactgaggccacacaggctggtgggccccgaatgccctatccccaaggcctcaccctgtcccctccctgcagaacccccagggcagctgctgccacagaagataacaacacccaagtcctctttttctcactaccacctgcagggtggtgttacccagcccccacaagcctgagtgcagtggcagacctcagctctctggacccctcctacagcactagagctaaatcatgaagttgaattgtaggaatttaccaccgtagtgtatctgaatcataaactagattatcatagttatctagtttatgagtcataagctagatttgattcttcaaagaagaaaagtcagtgagcaaatttaaaccagaactaagcattatattttctttttttttttttgagacagagtctcgctctgtcgcccaggctggagtgcagtggcacgatctcggcggctcactacaacctctgcctcccaggttcaaatgattctcctgcctcagcctcccgagtagctgggattacaggtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaatacccctctgcccacagcaccacccttctgtgctgttttttttgttgtttgtttgtttcttctttttgagacagagtcttgctctgttgccacgctggagtgcagtggtgtgatctcggctcactgcaacctcccgctcccaggttcaagcaagtcccctgagtagctgggactacaggcgtgtgccaccacatccggctaattttttgcattctttaatagagacggggttttgccatgttggccaggatggtctcaatctcctgacctcatgatccacctgcctcagcctcccaaagtgctggggttacaggcatgagccaccacgcccagccttttttttttttttttttttttcttgagagacagggtcttgctctgtcacccaggcacagcttactgcagccttgaactcctgggatcaatcagtcctcctgcctcagcctcccgagtagctaagactaacaggtatgtaccaccatgcctggtttattgttttatttttttggcagagatgggtctcactgtgttgcccaggctgatctcaaactcctggcctcaagcgatcctcccatctcagcctcccaaagtgctgggattacagacctgagccaccacacctgggcaacagagtgaaacctgtccctgttttcctgctcttactctcacctctgaggcctcctctgcctggaagagattacagggaaattccaggcagcccttgtcaattgtttttatgaattctttacctgttccttttaaagacaaggaaactgaggcccaaagttctaagttgtttggcaaatggagtctcctaccctcagctcctgcaaggacctgggggacccccaggtccagcagccacatgattctgcagcagacagggacctagagcacatctggatctcagccccacccctggcaacctgcctgcctagagaactcccaagatgacagactaagtaggattctgccatttagaataattctggtatcctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagctttgaatcccagggtcccctcagcttcactgggccacagtgtctgtcccaggaagaagcaaatggacagtgaggatgatggagagactacagctgccttgtctaaaacctgggatcttaaaagtgttattttggcttttattttttaaaaaaagaaaaggaaaa

SEQ ID NO: 183888 - DNA, 3490 bp, Homo sapiens
  Payload ID: 16235
  Gene Symbol: SLC35G1
  Gene Name: solute carrier family 35, member G1
  Uniprot ID: Q2M3R5
  ENST ID: ENST00000371408
  CDS Start-End: 62-1156
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattctagtttatcagcatgatgttaaatgtcagtgccataccatgatgcagcaccatgacactaacgccatgaattcaaacagcacgttttacacctggaacttcatcagaccaatactttgcagttagagagaatttaatatctagaaaagcttgggaggttagtcaggacttagggagtatacataaatggttacttgttgtaatgagccctttattggtgaggttgcaatagcttccagctcttactgtgtcagatgaagcatctgtcattatcttaagcctgcagagttgaaaggttataggctctttcctaccctctcatcataatttttccaaagcaaagaggaacttggcttctggggttcgtgccttagtgagaaagaatcttttccaatagttccaatgggggaatttttggcttgctgattttatcaattgccttgacacctgacaaaccctaaatgaagtctatgtaggtgagtcatctctgttccacctgatttacagtattggaatttagacttgcaaaaacatcattctgcaaatatcttagataattacagaatcaggagcatttgagaactctagaggtctcagaaatcatcacataggggccatgcttcgtagatagggatgatagagaggagacctgcccaagttgaatttccatggccttcctcccttccttagttccatgataaagtatggacagtaaaccactacttgagctacctaaggtgaattaactctcagggaaccctcttccagttctttaccttgcacagtgaaagaatcagtggcacctagaaagttaaatccctttaggcccatacactagagacatgttttgtttgaacaatgtagtttaagtacttgaatgtcacactatataactgaggttagagaaaatgtttcttctagcccttacagggtgtgattcttaaacacaatgtccaaggtgtatacaaggatatgtattgtaacaactatgggtatgtatattttgcagagcgtagtttctatatcttgaaaaggaaaatattttcataaattgtttttataagtactaataaaataatatgaaagaaagcta

SEQ ID NO: 183889 - DNA, 2402 bp, Homo sapiens
  Payload ID: 16235
  Gene Symbol: SLC35G1
  Gene Name: solute carrier family 35, member G1
  Uniprot ID: Q2M3R5
  ENST ID: ENST00000427197
  CDS Start-End: 62-1159
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggaagccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattct

SEQ ID NO: 183890 - DNA, 3036 bp, Homo sapiens
  Payload ID: 16235
  Gene Symbol: SLC35G1
  Gene Name: solute carrier family 35, member G1
  ENST ID: ENST00000483386
  CDS Start-End: 44-184
ggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcgccacattgctgtgaggaagcctgggctacatggagaagcccacatgaagaggcccatgtggagaggaactgaggccctgacacttggccccatctgcactaccagctgatagccagcatgagcctgccagccaggccagcacagtggctcacacctgtaatcccagcatttcgggaggccaaggtggccagatcacttgagtccaggagtttaaggctgcaatgagctacgatcgcgccactgcactccagcctgggtgacagtacgagatacaacagatgaacacacttcctgtttatgtgctttagttcctttgtatgtgcattttagaaaagtcagaagtctttggtactttgcagcatgtgtgcattggtacaacttctaggaagggcaatttggcaccatctatcagatttacttatgtgcaaaatgatatgtacaagtttattccagcctgatttgtaatagcaagaagaaatggaactagcctgaatgtccctcaatagagtactggttaagtaagtcatggtatatacccaaaataaaatgtaatgcaattaaaaataaatttaagaagagcaaggaagctttccatatatgggtgtggaataatgtccaaaattgttaagtgaaaaagcaaaattcatatcatggttgagtatgtgctcatttgtataaaaagagggtaaacagaatattccaggaggatatgcaagaaactgttaacattggttgcctttggcagctgaagggcgaggtgagaggagactttccactgaatccccttttacaccttttgaattttgaaccaggtgggtaaataacttagtcaaaataaaataaaataaaataaaataaaataaaattggtggaacaaaaataaaaaggtgacttgatggaaaagaaaggagaaagaaaaggagtaaaagacatagggagctacatatatacattatgtcatacatacatacatgcatagagagatgtttactgctttaatctgggctgtcaccctgactcaccttacggacttccttttgctccctcctcttttgcctcatagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagcgaaagaatagaaggtgatgacaacactgcatatatttcagttttatttcttccgatctactaattaacatttgttgggcagtagccataaacaatcctagccaatgcaaggaaacaccaaatattgtcaagccctcacattggtcataactggaagcaaacatgacatatatggactatataatcagtttgcgtgggctacagcaagatgttgcccaagagcctaggcatgagctggcttcctacggcctccaagcaggaaagaatggagctatacacagtcatctgaatatacagaagtgaaccctgggccagccacattcagccgtaacttccccagactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattacaaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttcacaaa

SEQ ID NO: 183891 - DNA, 2122 bp, Homo sapiens
  Payload ID: 16235
  Gene Symbol: SLC35G1
  Gene Name: solute carrier family 35, member G1
  ENST ID: ENST00000603665
  CDS Start-End: 13-204
gcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccagagtctgcagaccatacttaaattcccacatctccatgattgaagggaatataaagatgaaactgaagttcacctttttaataggactatatcctccaagatcctagaaagcgttgtgtggccctgattcagatgtctgctttcctatggcaccaaaacaatttttacttggaaaggacactaacatttattgaataaacctcatcccagccaagagcttcttaatctttgtctcattccctcaccaaccttgggagatagactgattgggaactgaagttcaaagaggttgaatggggttacctacctgctaaattctagtcccctcactagtaaatgatgaggttgggccatgaggtctgcctgactccaaagaccttgccctttccaatacttcatgctgcctccataattgagggtggtagaatgcagaacagggagtcatttgtcactgtggtggagaaagagttggtttttgactttgggatttagggatacatatgtcctccttcctccttcccctcctagagcaagagctagaagcgaaagaatagaaggtgatgacaacactgcatatatttcagttttatttcttccgatctactaattaacatttgttgggcagtagccataaacaatcctagccaatgcaaggaaacaccaaatattgtcaagccctcacattggtcataactggaagcaaacatgacatatatggactatataatcagtttgcgtgggctacagcaagatgttgcccaagagcctaggcatgagctggcttcctacggcctccaagcaggaaagaatggagctatacacagtcatctgaatatacagaagtgaaccctgggccagccacattcagccgtaacttccccagactgtttctacaggtgcagtgtgccaatcagaagaaaggtggccaggctcaggagaaaggacaggagagtgactctggcaggcttgctccattgtagagatgagatacaccaagatagtgacttcccagcttttctccccaaagcacccctaatagctgagaagaatctggaggcatagctaccatcacagctacactaaccaccatactttactgtatccttcaggtgtctgtcctagctagttttgtggtctggctccttcagtccctgcaacaagcctgtttattttcattatattgatgaggttatagagcttggacaagttacatgacttttcgaagatcacatagctaataagtgtcaagagtcttattctcaaaaccctggtctgtccaactacaagcctgtgctcctgactccactattctgcttaccctaagcctaaagctgcccacttcaagctcaaatcctcttggaggcttcatgctttaaaaaaaaaaaatccatgcaattttttgcatcctaattaataatatatctgtgtgttttagtgtaaatttttttttttaaattaccaattcagttatttagctttttattccccaaatctttggtaccctaggcagatgtgtcatatttatcctgggctttatgtacctctggtttgagggactcttgaacttcattttaagaaacatggcccaatgagtacacagtcaagtcttcatgtccctgaacactgcattacaaaatcagcactccttgttctttgtatatttgtgttatcaaataactatgtgattataatctggcttctcatataccataagtgcagaagagaatcaaaagattgagtacctgattccctaaactgtcaaatttcccgttgtatattaataaaatttgtatcgtttc

SEQ ID NO: 183892 - DNA, 726 bp, Homo sapiens
  Payload ID: 16235
  Gene Symbol: SLC35G1
  Gene Name: solute carrier family 35, member G1
  ENST ID: ENST00000494992
  CDS Start-End: 33-224
gcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccaggtaagaggacatgaattgccttggagttttaccctaaaggttgtggatcaggaaaggtcctaaacaaagcacaggggaatggcactaatctcaccagtaaggtgtgtagccaaaccagctgttccctgttaagaactgtaaaatagcctcaggcaggtccttcaggaggtatggacaagaaggcattgctatcacaggagacgacagctccatgcatgttcctgtccctgaaggccttccagtcagtcaagatgtggaggcggaagacagtgatataaatgatcctgaccctggtgcagtgactacatgtatgaaataagcctgcatgagtgttatatcaagataaaagggtcatatatgtgccataattggtcatcgaatg

SEQ ID NO: 183893 - DNA, 726 bp, Homo sapiens
  Payload ID: 16235
  Gene Symbol: SLC35G1
  Gene Name: solute carrier family 35, member G1
  ENST ID: ENST00000605679
  CDS Start-End: 34-225
ggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccacattgctgtgaggaagcctgggctacatggagaagcccacatgaagaggcccatgtggagaggaactgaggccctgacacttggccccatctgcactaccagctgatagccagcatgagcctgccagccaggtaagaggacatgaattgccttggagttttaccctaaaggttgtggatcaggaaaggtcctaaacaaagcacaggggaatggcactaatctcaccagtaaggtgtgtagccaaaccagctgttccctgttaagaactgtaaaatagcctcaggcaggtccttcaggaggtatggacaagaaggcattgctatcacaggagacgacagctccatgcatgttcctgtccctgaaggccttccagtcagtcaagatgtggaggcggaagacagtgatataaatgatcctgaccctggtaggctaatgtgtgtatttgtgtcttagtttttaagaaaaaagtttaaaaggtaaataaaataaaaaatattaaaaatagaaaaaaa

SEQ ID NO: 183894 - DNA, 1577 bp, Homo sapiens
  Payload ID: 16236
  Gene Symbol: SLC35G2
  Gene Name: solute carrier family 35, member G2
  Uniprot ID: Q8TBE7
  ENST ID: ENST00000393079
  CDS Start-End: 150-1388
aggcgcagagtccgcgcggcggcgcccctctccctccgcagtactccgggcagcgcccgcctcgattttcccaggcgagggcacgcccgcgtcagtcgcctccggggcaccttcctcgccacgacacgcagaattgattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatggaaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaagcaggactaccaggaaatactagactctcccattaaatgaatacctgattattattgtctcattaatgttcagttattatgtatactgccattttaatgtttacctatgaatgtcttttgtgttatataactgacagagtgctataaaatatataatatatacaaatgcagaaaatttattctagtctaatatattcaaatacaaatattaaatatatgaaatacgtta

SEQ ID NO: 183895 - DNA, 2060 bp, Homo sapiens
  Payload ID: 16236
  Gene Symbol: SLC35G2
  Gene Name: solute carrier family 35, member G2
  Uniprot ID: Q8TBE7
  ENST ID: ENST00000446465
  CDS Start-End: 629-1867
cccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcacaacagtctttttgggtaagggccgggctgggggcgacgcgccccgcccgctttgcagacttcggggtgctctgcacgacgcctgaaaggccgcggggcccgcatttctctgtgctgccctcctggagaaccgggacacggggacgggagggccagcatcggctacggcccggtttcccgtttctttccgctgtcgcgtgtctgggccctcctgcagcgtccatgatgaaggccaggggctgttgctttcctctcgcccagtagccaacccaagcaagggaattgattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatggaaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaagcaggactaccaggaaatactagactctcccattaaatgaatacctgattattattgtctcattaatgttcagttattatgtatactgccattttaatgtttacctatgaatgtcttttgtgttatataactgacagagtgctataaaatatataatatatacaaatgcagaaaatttattctagtctaatatattcaaatacaaatattaaatatatgaaatacgttatgaa

SEQ ID NO: 183896 - DNA, 2004 bp, Homo sapiens
  Payload ID: 16237
  Gene Symbol: SLC35G3
  Gene Name: solute carrier family 35, member G3
  Uniprot ID: Q8N808
  ENST ID: ENST00000297307
  CDS Start-End: 217-1233
gcgagaaacacccaagaatgatcaataaaaaaaaacaaaaaacaaaaaaagaaagaaaagaagcagagttggactcagtgggaaaataggcgtgctaccacctcaggagagttccagggaagaatcccacccccactccaatgaggtcacaatggctggagctctgaggggcccaggctccctgagccaggaggagaggagaaagtccaaggaaagatggctggcagtcacccctatttcaaccagcctgactccacacacccatcgccgccctccgctccacccagcctccgctggtaccagcgctgccagccctctgatgccaccagtggcctgctggtggccctgctgggtgggggcctgcctgctggcttcgtgggccccctttctcgtatggcttaccaggcttccaacctgccctcgctggagctgctcatctggcgatgcctcttccacctccctattgccctgctacttaaactgcgtggcgacccccttctgggaactcctgacatccgaagccgggccttcttctgtgccctgctcaacatcctcagcattggatgtgcctacagtgcggttcaggtggtgcccgctggcaacgctgccactgttcgcaaaggttcttccaccgtctgctccgccgtcctcactctctgccttgagagccagggtctcagtggctacgactggtgtggactgttgggctgcatcctaggactaatcatcattgtgggacctggactctggacactacaggaggggaccacgggtgtctacaccgccctgggctatgtggaggctttcctgggaggcctggcgctgtccctgaggcttctggtctatcgttctctgcactttcccccctgcctcccaacagtggccttcctatctggcttggtggggctgctgggctctgtgccaggcctctttgtgctgcaggcccccgtgttgcccagtgacctcctgagttggagttgtgtgggggcagtggggatcctcgccttggtctccttcacatgtgtgggctatgcggtcaccaaggcccaccctgccctggtgtgcgctgtcctacattccgaggtggttgtggcccttatactgcagtattatatgctccatgagactgtggcaccttctgacatcgtggcggcaggggttgtgctgggcagcattgccatcattacagcccagaacctcagctgtgagaggacagggagggtggaggagtgagatagaacttgggagcccgggggttgggagggacagggataaataaaggcaaagactgaagacaaacatgggaggagaagtgactggaaaagaactggtgtgggagagggatacctctcagagtcaagggtgacttggggacttggtggagagggactacgtggaagacctggggccagcctgggaccaagggatgtggagtccaggctgggtcctagaatcagggcataactaaggggtaaagtctgaggagcagatccaaagggctgaggcagggaggccgtgggccatggggaggacttcactcagcagcaaagagaagagcattggggctggagtgttccggcaaagacagagccagcagctgcgctgggggagggaagcgtgcctccccacccctcccctcacggggaaggtttcctttcctcgtgcttgtgccccccgcttggggtggtgacgtgacattgacatcaaacaaggattacagtgaatgtgaaaaaaaaaaaaaaagatacctgaatagacatttctatgacattttaaaagccatgaatttattttggcacaaatattttatcatatgcagtcacttctttgtaaatgattttttgtaaagtcattggatataaaagagtgattttcctcacctgagtacatgaaaagaaaatgctgaaatcaatgtataaatcaaatcatctgtactagcactgttaatctagaagaaagtggttgcatagagaagagtaagaatgtagaccagcttattgaagt

SEQ ID NO: 183897 - DNA, 1321 bp, Homo sapiens
  Payload ID: 16238
  Gene Symbol: SLC35G5
  Gene Name: solute carrier family 35, member G5
  Uniprot ID: Q96KT7
  ENST ID: ENST00000382435
  CDS Start-End: 220-1236
gcgagaaacacccaagaatgatcaattaaaaaaaaaaaaaagaaagaaagaaagaaagaaaagaagcagagttggactcagcgggaaaataggcgtgctaccacctcaggagagttccagggaagaaccccacccgcactccaatgaggtcacaatggctggagctctgaggggcccaggctccctgagccaggaggagaggagaaagtccaaggaaagatggctggcagtcacccctacttcaacctgcctgactccacacacccatcgccgccctccgctccacccagcctccgctggcaccagcgctgccagccctctggtgccaccaatggcctgctggtggccctgctgggtgggggcctgcctgctggcttcgtgggccccctttctcgtatggcttaccagggttccaacctgccctcgctggagctgctcatctgtcgatgcctcttccacctccctattgccctgctacttaaactgcgtggcgacccccttctgggacctcctgacatccgaggctgggcctgcttctgtgccctgctcaacgtcctcagcattggatgtgcctacagtgcagttcaggtggtgcccgctggcaacgctgccactgttcgcaaaggttcttccaccgtatgctccgctgtcctcaccctctgccttgagagccagggtctcggtggctacgagtggtgtggactgttgggcagcatcctaggactaatcatcattctgggacctggactctggacactacaggaggggaccacaggtgtctacaccaccctgggctatgtgcaggctttcctgggaggcctggcgctgtccctggggcttctggtctatcgttctctgcactttccctcctgcctcccaacagtggccttcctatctggcttggtggggctgctgggctgtgtgccaggcctctttgtgctgcagacccccgtgttgcccagtgacctcctgagttggagttgtgtgggggcagaggggatcctcgccttggtctccttcacatgtgtgggctatgcggtcaccaaggcccaccctgccctggtgtgcgctgtcctgcattccgaggtggttgtggcccttatactgcagtattatatgctccatgagactgtggcactttctgacatcatgggggcaggggttgtgctgggcagcattgccatcattacagcccggaacctcagctgtgagaggacagggaaggtggaggagtgagatagaacttgggagcccgggggttgggagggacagggataaataaagacaaagactgaagacaaaaaaaaaataaaagaaaaaa

SEQ ID NO: 183898 - DNA, 1697 bp, Homo sapiens
  Payload ID: 16239
  Gene Symbol: SLC35G6
  Gene Name: solute carrier family 35, member G6
  Uniprot ID: P0C7Q6
  ENST ID: ENST00000412468
  CDS Start-End: 186-1202
aaacaaaaaaagaaagaaagaaagaaaagaagcagagttggactcagcgggaaaataggcgtgctaccacctcaggagagttccagggaagaaccccacccccactccaaccatgtcacaatggctggagctctgaggggcccaggctccctgagccaggaggagaggagaaagtccaaggaaagatggctggcagtcacccctacttgaacccgcctgactccacacacccatcgccgccctccgctccacccagcctccgctggcaccagtgctgccagccctctgatgccaccaatggcctgctggtggccctgctgggtgggggcctgcctgctggcttcgtgggccccctttctcatatggcttaccaggcttccaacctgccctcgctggagctgctcatctgtcgatgcctcttccacctccctattgccctgctacttaaactgcgtggcgacccccttctgggacctcctgacatccgaggccgggcctacttctatgccctgctcaacgtcctcagcattggatgtgcctacagtgcggttcaggtggtgcccgctggcaacgctgccactgttcgcaaaggttcttccaccgtctgctccgccgtcctcaccctctgccttgagagccagggtctcagtggctacgactggtgtggactgttgggcagcatcctaggactaatcatcattgtgggacctggactctggacactacaggaggggatcacgggtgtctacaccgccctgggctatgggcaggctttcgtgggaggactggcgctgtccctggggcttctggtctatcgttctctgcactttccctcctgcctcccaacagtggccttcctatctggcttggtggggctgctgggctctgtgccaggcctctttgtgctgcagccccccgtgttgcccagtgatctcccgagttggagttgtgtgggggcagtggggatcctcgccttggtctccttcacatgtgtgagctatgcggtcaccaaggcccaccctgccctggtgtgcgctgtcctgcattccgaggtggtggtggcccttatactgcagtattatatgctccatgagactgtggcaccttctgacatcgtgggggcaggggttgtgctgggcagcattgccatcatcacagcctggaacctcagctgtgagagggaagggaaggtggaggagtgagatagaacttgggagcccgggggttgggagggacagggataaatagaggcaaagactgaagacaaacatgggaggagaagtgactggaaaagaactggtgtgggagagggatacctctcagagtcaagggtgacttggggacttggtggagagggactacctggaagacctggggccagcctgggaccaagggatgtggagaccaggctgggtcctggaatcagggcataactaaggggtaaagtctgaggagcagatccaaacggctgaggcagggaggccgtgggccacggggaggacttcactcagcagcaaagagaagagcattggggctggagtgttccggcaaagacagagccagcagctgcggtgggggaggggagcgtgcctccccacccctcccctcacggcaaaggtttcctttcctcgtgcttgtgccccccccttggggtggtgacgtgacattgacatcaaacaaggattactctgaatgtg

SEQ ID NO: 183899 - DNA, 5781 bp, Homo sapiens
  Payload ID: 16240
  Gene Symbol: SLC36A1
  Gene Name: solute carrier family 36 (proton/amino acid symporter), member 1
  Uniprot ID: Q7Z2H8
  ENST ID: ENST00000243389
  CDS Start-End: 224-1654
acgtgatgaggtccggaagcggctgccgggcagcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctcccaaatgttgtatctcagtattcttcctattcgagtctccagggggtggctggacctacctggtcatttgaaacaggcccccaagctggagtttttaatctggactctctggcttgctgtgacccctaaggcaatgcttctcttccctggattccttagtgtgggtcacagtactgtgttcttagttgctttagctcttaaaacatacgaagtgttgcctaaactgaaaatatttatcttttatttaaaatcagatttttgtttttagactgtcttagatctggggctattacgaatcacttcttcttcagtaaactttgactcaacttctcctgctgaaaagaagctcgctccagatgtctgcatgggtcctcggcactcttggctgaggactcaaaggttttaatcaggatcgtctaaaaatgtacctcggtgaggaggcacagattttgcctcctgttgaccagcctggtttcataccgaaaagacattgaaggactgcagaaatgtatgggtgcaccgggccgagggaagggtggctgagtgagaggcgtataaaatggggctgtgtgcatgcaggcccatgtttcagcctcagcccacgccaggtgaaaggatcagcaatgctctgttgccatcgtgctgggacgacaccagctctattgccaccgatgagtagctgaggtcagtgtgcacagagtttgaaattaagttaatagactttacagcagctggtctgacactacgcgcagtgctcggttgtttacaatcagtggggaaaagggcagaaccagtgcccggccccacactgcctctgtggcctggactttgaaaggaacccactgaacactaattatgagccctgtctttcccccagaatgcctccctgggtttcacaaacagccttgaggttggccctcctcaaggtcagccttcagatttgggagcaaacttcagagaaggcagaggaagatacattgccttgctgtgggctgcctcttctttcctcttggtgtgcgaagtatttcagaaggccattgatgaattccccctctttagctgtgtatttgtgcacgtgtgtgtgtacgtgcgtgtgtgtgtgtgttcctgtgtaagtaacagaccagactccttttctcttctgtcccgtcaccaggctcttgcttcactgcagatacagttcactctgaaagctggttgaaggagagcagcaaaaatgtatcaggggttttgcttctgtgtttcgccaaagctcataagggctgtgacccacccatatggccccagttttttctgtctcttctgttccaaagccaggagagctgacttccaggtgaagggatgggaaaagtggactctcattgtagtgactcccaacctacctaataatttgttaacttaggaatatgctatcattgttgacttgttcttccttaggagaaggacgattttcacccaccctttctgttctatggtggactcttaacaggtgctatgtgaccaggaatctagccgggagtagcagaggccctgtcttctgaagtctcaggcttagaagttaccaaagtgggctcagaaactgtcatctcctggttccaagttcgggctctggcagcccagccgctatcttagctgtctttcccagcggtgctaagagtggtctcagtgagaaggtagatgccaactggagggccagacctgtgtcctgcccatgtcctccttggtggacgtttctgtttactcagagctgctagagaccatcctgcccatccgagttctgagattgggactgtgatgttgggacctgaggactggatggtagaatactggggtcccccagctcttagcaggatgcaggctattgcttccacacccctggccgtgagaacgtggtatgtaggagagttggctgtagctttaggatttctggaagccaatttggcatggcctatttgatctctggcttgtgctcctgctacactgacagactgattgcgtggctctttcagaagacccaggaagggcagctccagccagaggaccttcctggctatgcaggtgcacagctcttaggcatcaagcaaagggtcagccagtcagtagtagtgggaggaagcccttcctcctcttatgcaagcagctcgcagccagcccagaatctcttatgcagcccaaagggcttcttgaggtagagagccctccccagtgtcttcccaggataagtagaaatatgatcacagagcaacggagcaaaggctttcgggagtgtgaggctgcatctgctggagcaaagggaaaccgtgggcttttccggccagatactcttgagctctgtgaccctgctcctgtcaccccaatttctccaagccagaggtagctttctcagagccccttggtggttctgtcctccaaatgctgctgttgggagcgggcttccagctctcagtgggcagtgcacctcctcctaaatgcaggcacttgctaggaagagtgtgagctggcgtcttctgttcaccctgcctagcagttgtcaccattcacaagtggcattatttatgttgtgctgctgtccagctgctaagatcccttcatctgcacaagccctggctagatatgtgtgaatgtgtggcatcatttcacttcagccgcccaattccatctctcctctgcagccagattcactggctgatgctcactgctcactgtctatccccacgaaatttagttttatcagtagtcttaaagtgttgatctcaaacaagtacattagaaaaatcatgtttcttctctctcatcttactttttcttctcagatttctcccttcctagaacattctctctgtttagcactaatgttcacctcgtattttttggaagtgcaaaaatctcaatttgtgtctgtttacagctctctctcctcactgctcacagcaaggggttctgtatcagtggatttcattttgtagctgctgagatgttaaggcaagcctcagcatctgcccctgctgggtgcacaatgctgcttcctcgaagagaagacacagagtccaagtggcaggacttgaggttggcttccactctgccttagaagttaattttccaaagtacattacaaatctctgaggccattaggggaaaaggaaggggtgtggtttgtctttgaaattacggttaatacttttagacagtaagtccggctggttgcagggctatttgccccgacagcatcagcctgtaacatttcttctctttcctttgtgccactgagtcgttccctggccagaggacataaatggtgctggtaggaggttatcagagtaaggaaggtagcagatataggtgcagggtgcctgtcattcactgtgttatttggtttaaatcaaagtgattctgggggaagctatgctctttcagtggataataaaattggtaactctattgtaaaacatgtcaatggtgtgtgaagaaaaatcaaccaatctgtaggtgttgataactagacagtactgtgtatgttacgtgcctgtgtggatgtgcacttccagcatggtatgtgtagcgatgtggatcatgccagagttcgtagatcctgttttggggtttgcacatggatcgtatgttaagctttttcttttcaataaatgaattttatttttatttttgaga

SEQ ID NO: 183900 - DNA, 977 bp, Homo sapiens
  Payload ID: 16240
  Gene Symbol: SLC36A1
  Gene Name: solute carrier family 36 (proton/amino acid symporter), member 1
  Uniprot ID: Q7Z2H8
  ENST ID: ENST00000429484
  CDS Start-End: 100-831
ctttcaatggtgtcttttcttgccttgtttcagaaggatctactagttggccctatcttgtgccaagactgacagcaaggaagctgctggctgactgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagatcctgtgaatggatttacagcccatgtagcagaccaaggtcttccacagagagcaggttcctctctgtcttcagcatgtggagtctcaaatggaacagttctgggcagagtgctttgcacagagggtgctcccaataaatgttttatcactgca

SEQ ID NO: 183901 - DNA, 552 bp, Homo sapiens
  Payload ID: 16240
  Gene Symbol: SLC36A1
  Gene Name: solute carrier family 36 (proton/amino acid symporter), member 1
  ENST ID: ENST00000517945
  CDS Start-End: 342-552
agcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagaattccatcgacagagaggagaaaatacatctggggaatttgccgctgctctgagttccaaagtccaaaccaatgtaattgtttcagaataacggatgacacttttagcttgcaaacaaggggcgccaatgcgtgaattctggtaggagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctgg

SEQ ID NO: 183902 - DNA, 2005 bp, Homo sapiens
  Payload ID: 16240
  Gene Symbol: SLC36A1
  Gene Name: solute carrier family 36 (proton/amino acid symporter), member 1
  Uniprot ID: Q7Z2H8
  ENST ID: ENST00000520701
  CDS Start-End: 139-1569
gagctcttcatccgcctgggcccaaccctggaactattcctttcaatggtgtcttttcttgccttgtttcagaaggatctactagttggccctatcttgtgccaagactgacagcaaggaagctgctggctgactgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaa

SEQ ID NO: 183903 - DNA, 488 bp, Homo sapiens
  Payload ID: 16240
  Gene Symbol: SLC36A1
  Gene Name: solute carrier family 36 (proton/amino acid symporter), member 1
  ENST ID: ENST00000519829
  CDS Start-End: 274-488
gccttctcttgtttcccatagaagaagctctcactgagtctgtttacttccacccaggccttggaagaatcctgtacctctctcctttggccaggccttactgtgatgagcacataaagaattccatcgacagagaggagaaaatacatctggggaatttgccgctgctctgagttccaaagtccaaaccaatgtaattgtttcagaataacggatgacacttttagcttgcaaacaaggggcgccaatgcgtgaattctggtaggagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggt

SEQ ID NO: 183904 - DNA, 524 bp, Homo sapiens
  Payload ID: 16240
  Gene Symbol: SLC36A1
  Gene Name: solute carrier family 36 (proton/amino acid symporter), member 1
  ENST ID: ENST00000517628
  CDS Start-End: 1-438
aggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgagtgtaagttaaaagacaggatacccttctgtttgctgtggttgaaaactggtgacatttagaaaataaaagtaaattttttttgta

SEQ ID NO: 183905 - DNA, 587 bp, Homo sapiens
  Payload ID: 16240
  Gene Symbol: SLC36A1
  Gene Name: solute carrier family 36 (proton/amino acid symporter), member 1
  ENST ID: ENST00000520111
  CDS Start-End: 289-587
agagctcttcatccgcctgggcccaaccctggaactattcctttcaatggtgtcttttcttgccttgtttcagaaggatctactagttggccctatcttgtgccaagactgacagcaaggaagctgctggctgaaattccatcgacagagaggagaaaatacatctggggaatttgccgctgctctgagttccaaagtccaaaccaatgtaattgtttcagaataacggatgacacttttagcttgcaaacaaggggcgccaatgcgtgaattctggtaggagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaa

SEQ ID NO: 183906 - DNA, 751 bp, Homo sapiens
  Payload ID: 16240
  Gene Symbol: SLC36A1
  Gene Name: solute carrier family 36 (proton/amino acid symporter), member 1
  ENST ID: ENST00000522185
  CDS Start-End: 1-268
ggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctgcccacttcactctagcccaccatcccctgccactgccagccctcactggctgccctggactgcattctgtttggggaattcatgtagagccttctgctgaagccattggtgctgatcagccgatgggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgcatcttggccatcctcatcccccgcctggacctggtcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccagccaagcaatgctcccatcttcatcaattccacctgtgccttcatatagggatctgggttcgtc

SEQ ID NO: 183907 - DNA, 1621 bp, Homo sapiens
  Payload ID: 16240
  Gene Symbol: SLC36A1
  Gene Name: solute carrier family 36 (proton/amino acid symporter), member 1
  ENST ID: ENST00000521925
  CDS Start-End: 193-1359
agcaaaggaggatggcgaggggctgatactgaacccgggaagggtgggctgtgctgaagccagagccggagccggagctggggccagaacccgagcagtgagttcctccactggctgccggctggcggcgctcgccgccttgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgtgagtagaagatgataattgccttgcttgtttttccctaaagggcacccagtctgcaggctttcatgagaaaagacaatgtgtgttgtagtgaagctggctatgtttgtgacagagaacctggcccatggcctcactttcagagttgaggcacctccagatggggaagtgaattaattacatatgtactgtaaagaacatgggaatgaggacagtggtttatgtatagatagggtatgaaatgctgtggaggtggttatcattcagagt

SEQ ID NO: 183908 - DNA, 1389 bp, Homo sapiens
  Payload ID: 16240
  Gene Symbol: SLC36A1
  Gene Name: solute carrier family 36 (proton/amino acid symporter), member 1
  Uniprot ID: Q7Z2H8
  ENST ID: ENST00000616007
  CDS Start-End: 144-1304
gcggctgccgggcagcaaaggaggatggcgaggggctgatactgaacccgggaagggtgggctgtgctgaagccagagccggagccggagctgggcaggacccacctcgccttcctcccggcgtggcagatgctccagctgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggtgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatcatccccttctttgtgtcccgagcgcccgagcactgtgagttagtggtggacctgtttgtgcgcacagtgctggtctgcctgacatgagtgtaagttaaaagacaggatacccttctgtttgctgtggttgaaaactggtgacatttagaaaataaaagtaaattttttttgt

SEQ ID NO: 183909 - DNA, 3421 bp, Homo sapiens
  Payload ID: 16241
  Gene Symbol: SLC36A2
  Gene Name: solute carrier family 36 (proton/amino acid symporter), member 2
  Uniprot ID: Q495M3
  ENST ID: ENST00000335244
  CDS Start-End: 131-1582
agcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacctggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggcatatcgtgagcttcttccttattatcacccaacttggcttctgctgtgtgtacattgtgtttttggctgataatttaaaacaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagagggccccaagtggcagcaactggccaaaggagatgcagccagctaagactgtccacactttggcagacaaccggttttcccttttctgggtctgttcaaaaagcaaacattaagggtgggcacataatccacaagccagaaagttgtgcacggctccagtgttgagatgggtagggccaagatgaccagtgtgaaaactctcagatagaaaggagccatgcatattaaatgaggggcaacaaacatttcaaacgattagataacattttctcccaactcaaagatcccaacaatgaataggaggcatggaagtagatgtgccaatggggagggatgaggagtgaacatgaatattatttgaatagactttacctcttaattcttgcaacatgcattcttgattacctactgtgtgccaaacaagattttgtagaatattgcaaaaatgaccataaattcctcgtgataatgtgactttgcacctgctcctatgaaaagatgaagtctgtatctgtatcccttaaatttttttgcttgtttgtcggttttgttttgtgttttgtttttttgagatgaagtctcgctctgttgcccaggctggagtgcaatggcacaatctcggctcactgcaacctccacctcctgggttcaagcgattcttctgcctcagcctcccaagtagctaggattacaagtgcctgccactatgcctggctaatttttgtttttcgtagagatggggttttaccatgttggccaggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaata

SEQ ID NO: 183910 - DNA, 2059 bp, Homo sapiens
  Payload ID: 16241
  Gene Symbol: SLC36A2
  Gene Name: solute carrier family 36 (proton/amino acid symporter), member 2
  ENST ID: ENST00000518280
  CDS Start-End: 69-512
ccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacctggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagaggg

SEQ ID NO: 183911 - DNA, 403 bp, Homo sapiens
  Payload ID: 16241
  Gene Symbol: SLC36A2
  Gene Name: solute carrier family 36 (proton/amino acid symporter), member 2
  ENST ID: ENST00000523044
  CDS Start-End: 1-323
aggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggtatcttcatgggctgtcaggtggtggggactcaggaatgggtggaaacgtataggtcacttcctcctcccttccacagctgggaaactgaggtctagagagcctcccacagaagaagcagaattgtcattggaa

SEQ ID NO: 183912 - DNA, 2156 bp, Homo sapiens
  Payload ID: 16241
  Gene Symbol: SLC36A2
  Gene Name: solute carrier family 36 (proton/amino acid symporter), member 2
  ENST ID: ENST00000518617
  CDS Start-End: 69-512
ccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacctggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtgagcgtccactgtctgggcagtaccacagcttatcaacgcacctgtcaaagaacatttgggttgtttctagtttttgacaatcatgaatgatactgccgttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgcctcctggccatcctcatcccccgcctggacctggtcatctccctggtgggctccgtgagtggcaccgccctggccctcatcatcccaccgctcctggaggtcaccacgttctactcagagggcatgagccccctcaccatcttcaaggacgccctgatcagcatcctgggcttcgtgggctttgtggtggggacctaccaggccctggacgagctgctcaagtcagaagactctcaccccttttccaactccaccacttttgttcggtgagcctggcactgctccttgcctaccagcacccgacttttaattatatggatctctttttttttttttttttttttttgagacggagtttctgtcttgttgcccagactggagtacaatgatgcgatctcagctcaccacaacttcggcctcctgggttcaagcgattctcctgcctcagcctcccgagtagttgggattagaggcatagtccagcacgcctggctaattttgtatttttagtagagacggggtttctccatgttggtcaggctggtcttgaactcccgacctcaggtgatccacccaccccggcctcccaaaatgctgggatcacaggcgtgagccacctcgcctggccagatctcttttatatgcattatctttatgtcactgctttgccttttctctgggccaagtcatggtgaaacaagaaagctacaagctctaaatggtaattttttacatttttgttttgtttattacttcttcttttcatacctctggcattccactacattgtgagctttcccttggaaggctctggactctatccaagcttatgataattcacacaatgaatttcatacctagcgtggagctatgcaagaagcagccaccagaggg

SEQ ID NO: 183913 - DNA, 1471 bp, Homo sapiens
  Payload ID: 16241
  Gene Symbol: SLC36A2
  Gene Name: solute carrier family 36 (proton/amino acid symporter), member 2
  ENST ID: ENST00000521967
  CDS Start-End: 131-1318
agcttggccagagccagcccgggcacacaccactgtgctggggtgtacatctacactagacaccttcctgcttccctccttccagagcagacctctttgtcaccccgagctccttgtttcttaagcagtcatgtctgtgacaaaaagtactgagggtccccagggagccgttgccatcaaattggaccttatgtcgcctcctgaaagtgccaagaagttggagaacaaggactctacattcttggatgaaagtccttcagagtcagcaggcttgaagaagaccaagggcataacagtgttccaggccttgattcacctggtgaaaggcaacatgggcacagggatcctgggactacccctcgctgtgaagaacgcgggcatcctgatgggcccactcagtctgctggtgatgggcttcattgcctgccactgtatgcacatcctggtcaagtgtgcccagcgcttctgtaagaggcttaacaagccctttatggactatggggacacggtgatgcatggactagaagccaaccccaacgcctggctccagaatcacgctcactggggaaggcatatcgtgagcttcttccttattatcacccaacttggcttctgctgtgtgtacattgtgtttttggctgataatttaaaacaggtagtggaagctgttaatagcacaaccaacaactgctattccaatgagacggtgattctgacccccaccatggactcgcgactctacatgctctccttcctgcccttcctggtgctgctggtcctcatccggaacctcaggatcttgaccatcttctccatgctggccaacatcagcatgctggtcagcttggtcatcatcatacagtacattacccaggaaatcccagaccccagccggttgccactggtagcaagctggaagacctaccctctcttcttcggaacagccattttttcttttgaaagcattggtgtggttctgcctctggaaaacaagatgaagaatgcccgccacttcccagccatcctgtctttgggaatgtccatcgtcacttccctatacattggcatggcggctctgggctacctgcggtttggagatgacatcaaggccagcataagccttaacctgcctaactgctggctgtaccagtctgtcaagcttctctacattgccggcatcctgtgcacctatgccctgcagttctacgtccctgcagaaatcatcatcccctttgccatctcccgggtgtcaacacgctgggcactgcctctggatctgtccattcgcctcgtcatggtctgcctgacatgtgagtagaaaggagagtgcagtgttcctgctgatcttttctgagggctataaagaatcagccagatgggccggatgcattggcttacacctgtaatcctggcactttgggaggccgaggcgggtggatcacctgaggtcaggagtttcagacaagcctgg

SEQ ID NO: 183914 - DNA, 6012 bp, Homo sapiens
  Payload ID: 16242
  Gene Symbol: SLC36A4
  Gene Name: solute carrier family 36 (proton/amino acid symporter), member 4
  Uniprot ID: Q6YBV0
  ENST ID: ENST00000326402
  CDS Start-End: 132-1646
cgccggggcagggaggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctgaaaattgaaaaaattaaaatgtaaaaaaattaaagaataaaaatacttctattattcttttatctcagtaagaaataccttaaccaagttatctctcttttatgctactcttttgccactcacttgagaacagaataggatttcaacaataagagaataaaataagaacatgtataacaaaaagctctctccagatcatccctgtgaatgccaaagtaaactttatgtacagtgtaaaaaaaaaaaatctcagttatgtttttattagccaaattctaatgattggctcctggaagtatagaaaactcccattaacataatataagcatcagaaaattgcaaacactagaattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagcttaattttagtgttgaatctatttgattatattttaatactttgaaaatgaatgtgtgatttttaatagtatatgtgacctgagcagaaaatcagggaactccaagaagcctacactgtggccatataaacctcagcaagagaaagaagctatgttcttttaaaacagaatagagaccgcttgctggtgaaactcctggctagtaagatgtgtgtctagctatactatttgtggcttgagcttttttaattattaccttcctttcctgagttttgtaggcaccacattcctgaatggcagaaaatagacacctcagaaaacggaggatttgtggactctttccagccctgtggcttttcttatcacagccttttatttattatgagcagaataaaagaatcagctaggtgtggtggtctgtgcttataatcccagctactctggaggataagttgggaggatcacttgagaggccaggagcttgagaccagcctgggcagcatagtgagacctcgactctataaaacataaaaatttaaaaaaaaattagcctgatgtggcgtgtacctgtagtcccagctactgaggaggctgaagcaggaggatccctcgagcacaaaagtttcaggctgtggtaagctatgactgtgccactgcacaccagcctgagttacagagggagatcccaactcttaaaaactaaaacaacaataaatatatacaagaatcataacataaagggattcatgcttagaaaaaatccataaactcccttctaaatattgagacactccaggcttctttcagacaaataacttctaattattccatatttttcaagttattaaccaagataaagaatctctcagttagtggggaaaatgaaaattattaagaatagaattgtcttctgactttaaaaacaatttagactttaaaacatgaactgtttactcaggctggtgatactctagtttgttagtataccatacttgaagatatcatcaagatcactatagttgtatatattctctatttttatatgtaaatgttaacttagttcaagtattttttgcttgtatcgttaactgatcatcaaatacaatcctaaagatatatcagaagctttattttggtacaaagtcataagaatcaaaacttttttaaccattcacattaggtatcaacagtaattgtttgagatacttttatatcaattctgttacactgagcctttagtcatactaagagaatgcagaagaagttataggaaaacgaatcttcactgaaactagtattatataatcttgaattagatgtttaaaaaactttatagcttgatataaaatgagttgaaaattattatttaataggaagcagcattagatttttgtcacctgttttcagataatatttctagtctatgtatgttatttaatttttacactttggcccattgtttattttccttaaggaattcatcaaatgcaatgaaatttgaataaaattgatcatagcaataaataatttttaaattcagcacaaactcatcttgagtatattatcaatcaggcttcctttagcaataagaatggtgaatcaacatccagtactaaattcaataaatgatgaatactttaaatacaagaaaaagttgaattgcagaaaagaagaggggctaaaaaggaagaaagttttaattctcaacaagaaacactatttagatggaaagcttaaatgtattcttattaagggtatttgatgatgcattttatttgcaaaaataaccagtgggtaattttttctctgaaaatttagctttaataagtcgtaaaatttcctaaagattttggagacgatatttcgattataccagctcttgcttttattttgggagcctggagaaatgagagtgattgcacctgtcaaattttgtatctcatcacttttggatcatcacactgtgactaaaatgacttcagcattttgttggccaccacagtgaagaactattccctgaaagttaatcagttgcctgagagacttttctgctactgaggggaaagaaaggaaagctttatttacctctaatgagctccgttccaagtcagttaatcactgttcccttacacccaagagtttcatcagtatcagagtcaacttgtcaaaacactggttctcagacgtttttttcagagggacttcttttccccacatggccagatttctttacaattaagaaaataagagctacagcgtattcttggttaaaaaccagtttagatgatgttaccaaatgaaaacaagtctgtattagcaaatgccacattatatttagtcgtattctcactaaattctccgttattaaaatgatttctgcatcttgcctggaaaatgcacttacatatttacaagcgttgtatgtcaatgtgcatgttttgaatttcctaacagtgtctaatcttagtagtttcatagtagttatgtaaaatctctttaactgcaaaatactataaaatattacttgaaatattaaagtattagtgccatttctagctgtggcaaggcacaagtcttactatagcttacttatgtcttctcatagatttcagtacagcatctgagtagtggatctgtttactgacagtatacacaaactaggtcttgacctcacttctttcttcatttaaaaggagaagatttgaaatagagctagtgtaaataataaataaaattatttaaatagcatcagtggctcaataccatctgttgaggaataaaataatttggttaacatacagaacatcgataatatacaataatgactttttaaaaaatgagtctgatctttttggctcacctagcttcccttaataagaaaatttgagaaacttggatctgaaaagtgtagttgtacttcctaacattaaattcctggctgtaatagttaatactttggcagcattatggttagtcttgtttatgccattggcacttactaggctaaactttctgaaactgattggttttgacctatgagataaggaaacatgcctaagaaatggctagaaatgctatttattgccctatgataagtgaaatagcaaatcactcttgattcttaaaatttcatattaaaattagctagttcctacatgcatgcgtgcacaagtatatgcagacacacacacaaatcagtaatctatgtgaactagatactaatactaaattactatttaaattgggtccagaaagatgctgttttgaaaagaacactaaaaatatttcattagcgttttcttgataacaaataggaaaatatatgtttacaccctgaataaattcagctgtgggtggatttttgtttttcaaaatgattttgttagtttgaatgaaacctaaatataacattcaagtcaattcttttaacatttttctttataacagaatatgaaaaacgctgtcttaaagtgttgtaacttttctgaattttcaataaaatattttgcttgcagtt

SEQ ID NO: 183915 - DNA, 888 bp, Homo sapiens
  Payload ID: 16242
  Gene Symbol: SLC36A4
  Gene Name: solute carrier family 36 (proton/amino acid symporter), member 4
  ENST ID: ENST00000534116
  CDS Start-End: 49-888
cttggaccaatcagccttgtgtttataggaattatttctgttcactgtatgcacatattggtacgttgcagtcactttctatgtctgaggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatgg

SEQ ID NO: 183916 - DNA, 711 bp, Homo sapiens
  Payload ID: 16242
  Gene Symbol: SLC36A4
  Gene Name: solute carrier family 36 (proton/amino acid symporter), member 4
  ENST ID: ENST00000524875
  CDS Start-End: 133-468
gcgccggggcagggaggcgggcaccaggcgcgggtccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaatgttttacattttggtaaacatgtgagatcgtaggaagtcctattagatagccaatctctgtctctag

SEQ ID NO: 183917 - DNA, 1917 bp, Homo sapiens
  Payload ID: 16242
  Gene Symbol: SLC36A4
  Gene Name: solute carrier family 36 (proton/amino acid symporter), member 4
  Uniprot ID: Q6YBV0
  ENST ID: ENST00000529184
  CDS Start-End: 586-1695
ttttttcccaatgatgctttaaggaagttatcattgttctgcttttcaaatgctgcagccccattcggaatctccagatgaatcctcattttactccttgttatcccagagtttcgaacaggtcgtgctgaccagaatgaacaggagatacctgtagcttgctcacttggcaaagtttgtttgttttttgctgctttcctcccatcttgtttcttggcgacagggcgtgtttgtttacggtttcccgctgtccaaaataaaaaaatatggatgtaatgaggcccttgataaatgagcagaattttgatgggacatcagatgaagaacatgagcaagagcttctgcctgttcagaagcattaccaacttgatgatcaagagggcatttcatttgtacaaactcttatgcaccttcttaaaggaaatattggaactggccttttaggacttccattggcaataaaaaatgcaggcatagtgcttggaccaatcagccttgtgtttataggaattatttctgttcactgtatgcacatattggtttaaaaagtcaacattaggttatagtgacactgtgagctttgctatggaagtgagtccttggagttgtcttcagaagcaagcagcatgggggcggagtgtggttgacttttttctggtgataacacagctgggattctgtagtgtttatattgtcttcttagctgaaaatgtgaaacaagttcatgaaggattcctggagagtaaagtgtttatttcaaatagtaccaattcatcaaacccttgtgagagaagaagtgttgacctaaggatatatatgctttgctttcttccatttataattcttttggtcttcattcgtgaactaaagaatctatttgtactttcattccttgccaacgtttccatggctgtcagtcttgtgataatttaccagtatgttgtcaggaacatgccagatccccacaaccttccaatagtggctggttggaagaaatacccactcttttttggtactgctgtatttgcttttgaaggcataggagtggtccttccactggaaaaccaaatgaaagaatcaaagcgtttccctcaagcgttgaatattggcatggggattgttacaactttgtatgtaacattagctactttaggatatatgtgtttccatgatgaaatcaaaggcagcataactttaaatcttccccaagatgtatggttatatcaatcagtgaaaattctatattcctttggcatttttgtgacatattcaattcagttctatgttccagcagagatcattatccctgggatcacatccaaatttcatactaaatggaagcaaatctgtgaatttgggataagatccttcttggttagtattacttgtgccggagcaattcttattcctcgtttagacattgtgatttccttcgttggagctgtgagcagcagcacattggccctaatcctgccacctttggttgaaattcttacattttcgaaggaacattataatatatggatggtcctgaaaaatatttctatagcattcactggagttgttggcttcttattaggtacatatataactgttgaagaaattatttatcctactcccaaagttgtagctggcactccacagagtccttttctaaatttgaattcaacatgcttaacatctggtttgaaatagtaaaagcagaatcatgagtcttctatttttgtcccatttctgaaaattatcaagataactagtaaaatacattgctatatacataaaaatggtaacaaactctgttttctttggcacgatattaatattttggaagtaatcataactctttaccagtagtggtaaacctatgaaaaatccttgcttttaagtgttagcaatagttcaaaaaattaagttctg

SEQ ID NO: 183918 - DNA, 2456 bp, Homo sapiens
  Payload ID: 16243
  Gene Symbol: SLC36A3
  Gene Name: solute carrier family 36, member 3
  Uniprot ID: Q495N2
  ENST ID: ENST00000335230
  CDS Start-End: 413-1825
gagcctggccccacgtccaggcaccaggacctccaatccaatggtgtcttcttcctcccagtcacactgttcactttgccctacagcagcaagggctaaactaggagaggccaaaagcccaggcaagtcctggttgggcaagcaattgcgagtgaaactgaggaccatcctgactgagatgggtctttcataagtcccccaagagccaggtgaggcatcatcaacatcagcctctcctgccaccaccgcttccctgattcatgcacttcaggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaaggtacactgtcagcttcttattagtcatcacccagctgggcttctgcagtgtttattttatgtttatggcagacaatttacaacagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccccagtttgacttccatgtggatgttatataccttcatcaaatcccaacatctctatattaattagtggcgtctttatctttccaagagaaatgcagatgagaaaagttagcactgatgtctctcaggctacacctcttttggttttatattttttggatggccttttgtacctctgaaccaaaattagattcaactattcatattatcagcctcattttatggaaaagggatgccacttaccccaatagcccttgaaacagagaccaagcataaatacaaaagtaactgttttctctacactgcagtagctgcccttaaagcatcagatttagaaaagtgtatgttgggcgaagggagttttctatttagatattctaagtagaagagtcatagacagaacaaaaacagaactcagcagtaattttgtccaaccactggctccgccactgatttcctactggccctcaggcaagttcctccccatctctcagtctatgaagtgaacagttggactaactgattattaaggactctgtcaactctgatattctgaaagtgaataaaagaaattaacttatccaccaaccac

SEQ ID NO: 183919 - DNA, 1720 bp, Homo sapiens
  Payload ID: 16243
  Gene Symbol: SLC36A3
  Gene Name: solute carrier family 36, member 3
  Uniprot ID: Q495N2
  ENST ID: ENST00000377713
  CDS Start-End: 143-1678
ggcttcagccagcagcacgcatccttggggttaggagccagcatctcaggtcagcagccatggtttctctggagaaagacccatcagaggctcattcagagccttaaccctgagcctctgccacctacccaccgtgttgaagatgtcattgcttggaagggactacaacagtgagctgaactccttggacaacggacctcagtcaccctcagagagcagcagtagcattacttcagagaatgtccatcctgctggagaagctggactatcgatgatgcaaactttgatccacttgttgaaatgcaacattggcacagggctcctggggcttcccctggccataaagaatgccggcttgttggtcggtcctgtcagccttctggccatcggggtcctcaccgtgcactgcatggtcatcctgttgaactgtgctcaacacctcagccagagactgcagaagacttttgtgaactatggagaggccacgatgtacggccttgaaacctgcccgaacacctggctgagggcccatgcagtgtggggaagatggaatttggctctgtcacccaggctggagtgcagtggcaagatctcagctcactgcaacccccaccttcagggttcaagcaattctcctgcccaagcctcccgagtagctgggatttacaggtacactgtcagcttcttattagtcatcacccagctgggcttctgcagtgtttattttatgtttatggcagacaatttacaacagatggtggaaaaagcccacgtgacctccaacatctgccagcccagggagattctgacgctgacccccatcctggacattcgtttctacatgctgataatcctgcccttcctgatcctgttggtgtttatccagaacctcaaggtgctgtccgtcttctcgacattggccaacatcaccacccttgggagcatggctctgatctttgagtatatcatggaggggattccatatcccagcaacctacccttgatggcaaactggaagaccttcttgctgttctttggtacagccatcttcacatttgaaggcgtcggtatggttctgcctctcaaaaaccagatgaagcatccacagcagttttcttttgttctgtacttggggatgtccattgtcatcatcctctatatcttactggggacactgggctacatgaagtttgggtcagacacccaggccagcatcaccctcaacttgcccaattgctggttgtaccagtcagtcaagctgatgtactctatcggcatcttcttcacctatgccctccagttccacgtcccagctgagatcatcatcccgtttgccatctcccaagtgtcagagagctgggcactgtttgtagacctgtctgtccgctcagccttggtctgtctaacctgtgtctcagccatcctcatcccccgcctggacttggtcatctccctggtaggctccgtgagcagcagcgccctggctctcatcatcccagccctcctggagatcgtcatcttttactctgaggacatgagctgtgtcaccattgccaaggacatcatgattagcatcgtgggccttttagggtgtatatttgggacataccaagccctctatgagttgccccaacccatcagccattccatggccaactccacaggtgtccatgcataattatctgtttttattctaatagctctcccttcctcccatccc

SEQ ID NO: 183920 - DNA, 3664 bp, Homo sapiens
  Payload ID: 16244
  Gene Symbol: SLC37A1
  Gene Name: solute carrier family 37 (glucose-6-phosphate transporter), member 1
  Uniprot ID: P57057
  ENST ID: ENST00000352133
  CDS Start-End: 983-2584
cggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactca

SEQ ID NO: 183921 - DNA, 3094 bp, Homo sapiens
  Payload ID: 16244
  Gene Symbol: SLC37A1
  Gene Name: solute carrier family 37 (glucose-6-phosphate transporter), member 1
  Uniprot ID: P57057
  ENST ID: ENST00000398341
  CDS Start-End: 413-2014
tgggaagttcgcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactca

SEQ ID NO: 183922 - DNA, 494 bp, Homo sapiens
  Payload ID: 16244
  Gene Symbol: SLC37A1
  Gene Name: solute carrier family 37 (glucose-6-phosphate transporter), member 1
  ENST ID: ENST00000398343
  CDS Start-End: 439-494
ggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaagctctttgcctggaaggtgcctgcctgcctgcctgccggcccttgaacttaaatcgtctgaagttgtagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtg

SEQ ID NO: 183923 - DNA, 568 bp, Homo sapiens
  Payload ID: 16244
  Gene Symbol: SLC37A1
  Gene Name: solute carrier family 37 (glucose-6-phosphate transporter), member 1
  ENST ID: ENST00000419522
  CDS Start-End: 513-568
ggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcagctttatagaattgagagattgctgagcctaaatacatgttgctgcattgcctccgagaatggccggacctatccccactctcaccaaaacagagtgtgggactcactgctccctcgcctactagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtg

SEQ ID NO: 183924 - DNA, 2696 bp, Homo sapiens
  Payload ID: 16245
  Gene Symbol: SLC37A2
  Gene Name: solute carrier family 37 (glucose-6-phosphate transporter), member 2
  Uniprot ID: Q8TED4
  ENST ID: ENST00000308074
  CDS Start-End: 33-1550
gtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcggctctagtatggtcctaacccaccagtgatagtattttcctcaagtcccatgacttttgtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcagactcttgcttgttcagattccaagacagaaggcttcacaaggccaacgcctggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgc

SEQ ID NO: 183925 - DNA, 2910 bp, Homo sapiens
  Payload ID: 16245
  Gene Symbol: SLC37A2
  Gene Name: solute carrier family 37 (glucose-6-phosphate transporter), member 2
  Uniprot ID: Q8TED4
  ENST ID: ENST00000403796
  CDS Start-End: 302-1807
agaaagtgcagggcggaatgaggagccccagcacctcagagctgtcgggcagtggcggggaagcaaagcacaggagcgctgtggtgccagcggccgggctagggacgactggcgggtttgcgctggacccgaccccgagggcgggcgcaagggggcgggcgctgccgtactcaggccgcggggccagggcgggccggccggcggggcatttaaaccccgctgacagccagtccagcccgggacacgcgcccagctctgtagcctcctccgtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcagactcttgcttgttcagattccaagacagaaggcttcacaaggccaacgcctggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgctg

SEQ ID NO: 183926 - DNA, 552 bp, Homo sapiens
  Payload ID: 16245
  Gene Symbol: SLC37A2
  Gene Name: solute carrier family 37 (glucose-6-phosphate transporter), member 2
  ENST ID: ENST00000532000
  CDS Start-End: 103-552
cccgggacacgcgcccagctctgtagcctcctccgtcgactcagccttaggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccac

SEQ ID NO: 183927 - DNA, 2606 bp, Homo sapiens
  Payload ID: 16246
  Gene Symbol: SLC37A4
  Gene Name: solute carrier family 37 (glucose-6-phosphate transporter), member 4
  ENST ID: ENST00000545985
  CDS Start-End: 758-2047
gcttgcgcagccttcgctagccccgccccgtcctattcgggctcccgcctctgttcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggtgccacgagcccgccgcctcttcgccgcccgccgcctctcctcctctcccgcccgccgcctggccctcccctaccaggctgagcctctgggtgccagaagcgcggggcctccgggagaatacgtgcggtcgcccgctccgcgtgcgcctacgccttctgctccagttgctttcccaattgagcggaaaagccggggcatgttgccggggccctgggcgggacggttgtgccctgcagcccgaagcccgccggggcaccttcccgcccacgagctgcccagtccctctgcttgcggcccctgccaacgtcccacaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgggtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacac

SEQ ID NO: 183928 - DNA, 2032 bp, Homo sapiens
  Payload ID: 16246
  Gene Symbol: SLC37A4
  Gene Name: solute carrier family 37 (glucose-6-phosphate transporter), member 4
  ENST ID: ENST00000538950
  CDS Start-End: 403-1473
gcttgcgcagccttcgctagccccgccccgtcctattcgggctcccgcctctgttcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggagggacaaggtccctgactccaatcctgagccctttgccccatgttgggtggtggagcaacagaactgctagaggcccgggactggcatccagagtgagggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgggtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacac

SEQ ID NO: 183929 - DNA, 2356 bp, Homo sapiens
  Payload ID: 16246
  Gene Symbol: SLC37A4
  Gene Name: solute carrier family 37 (glucose-6-phosphate transporter), member 4
  ENST ID: ENST00000357590
  CDS Start-End: 442-1797
gcttgcgcagccttcgctagccccgccccgtcctattcgggctcccgcctctgttcagttccagagacaattcatgggtcttggggccaccgaggcgctgtccctgaccaccagcacgagacccctttctatcgcgccagtcctgtggtctccgcacctctccagctcctgcacccccggcccccgtggttcccagccgcacagtagcgtgtcctgggtagcgtgaggacccacggggctgggcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgggtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaaggatgttgctttctggactctggctcttcaccctctcgcggagctcacaggctttacagagcatgagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacac

SEQ ID NO: 183930 - DNA, 2102 bp, Homo sapiens
  Payload ID: 16246
  Gene Symbol: SLC37A4
  Gene Name: solute carrier family 37 (glucose-6-phosphate transporter), member 4
  ENST ID: ENST00000330775
  CDS Start-End: 254-1543
gcttgcgcagccttcgctagccccgccccgtcctattcgggctcccgcctctgttcaggacactgggtccccttggagcctccccaggcttaatgattgtccagaaggcggctataaagggagcctgggaggctgggtggaggagggagcagaaaaaacccaactcagcagatctgggaactgtgagagcggcaagcaggaactgtggtcagaggctgtgcgtcttggctggtagggcctgctcttttctaccatggcagcccagggctatggctattatcgcactgtgatcttctcagccatgtttgggggctacagcctgtattacttcaatcgcaagaccttctcctttgtcatgccatcattggtggaagagatccctttggacaaggatgatttggggttcatcaccagcagccagtcggcagcttatgctatcagcaagtttgtcagtggggtgctgtctgaccagatgagtgctcgctggctcttctcttctgggctgctcctggttggcctggtcaacatattctttgcctggagctccacagtacctgtctttgctgccctctggttccttaatggcctggcccaggggctgggctggcccccatgtgggaaggtcctgcggaagtggtttgagccatctcagtttggcacttggtgggccatcctgtcaaccagcatgaacctggctggagggctgggccctatcctggcaaccatccttgcccagagctacagctggcgcagcacgctggccctatctggggcactgtgggtggttgtctccttcctctgtctcctgctcatccacaatgaacctgctgatgttggactccgcaacctggaccccatgccctctgagggcaagaagggctccttgaaggaggagagcaccctgcaggagctgctgctgtccccttacctgtgggtgctctccactggttaccttgtggtgtttggagtaaagacctgctgtactgactggggccagttcttccttatccaggagaaaggacagtcagcccttgtaggtagctcctacatgagtgccctggaagttgggggccttgtaggcagcatcgcagctggctacctgtcagaccgggccatggcaaaggcgggactgtccaactacgggaaccctcgccatggcctgttgctgttcatgatggctggcatgacagtgtccatgtacctcttccgggtaacagtgaccagtgactcccccaagctctggatcctggtattgggagctgtatttggtttctcctcgtatggccccattgccctgtttggagtcatagccaacgagagtgcccctcccaacttgtgtggcacctcccacgccattgtgggactcatggccaatgtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacac

SEQ ID NO: 183931 - DNA, 3349 bp, Homo sapiens
  Payload ID: 16247
  Gene Symbol: SLC37A3
  Gene Name: solute carrier family 37, member 3
  Uniprot ID: Q8NCC5
  ENST ID: ENST00000326232
  CDS Start-End: 205-1689
gggtcacgtgggcgtccggaaaccctggtcgcaccgccaggggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 183932 - DNA, 2955 bp, Homo sapiens
  Payload ID: 16247
  Gene Symbol: SLC37A3
  Gene Name: solute carrier family 37, member 3
  Uniprot ID: Q8NCC5
  ENST ID: ENST00000340308
  CDS Start-End: 113-1444
gcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcatagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 183933 - DNA, 3254 bp, Homo sapiens
  Payload ID: 16247
  Gene Symbol: SLC37A3
  Gene Name: solute carrier family 37, member 3
  Uniprot ID: Q8NCC5
  ENST ID: ENST00000447932
  CDS Start-End: 158-1594
ctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 183934 - DNA, 544 bp, Homo sapiens
  Payload ID: 16247
  Gene Symbol: SLC37A3
  Gene Name: solute carrier family 37, member 3
  ENST ID: ENST00000491505
  CDS Start-End: 501-544
gccttgctgggaggcacaggcagcgtccaccccgatgatgtcctcccgccggcatcccgcagccttcgccttcctggttcacctgtcgcttacctgtctcgctctctcacctctgctggtcagcagatctgaatatctctttgtgaggagtcagagaaaggagatgatgcaaagagaaggaagcaaaaacaaaactaaaagaactttgaaggtatatgagaagaaaaagctgaaaagaaaatgtctgcctcactccctcaaaaattctaccatagagcaaaggttgacgtccagaaaacctcaagtttatcagtcccagatgctggcagtagaagcataaagctgagctaacattactggccaggtccgcagcagcagagttctgtgggctcccagcctccgccctcctcgccctcctccgcgccggcagaaggaagaaatgatgtaaatcactcatccaaaccttaaggtcaaaggtgagaaggaaggtcaggaagaacatggcctggccaaatgtttttcaaagagggtctctgctgtccca

SEQ ID NO: 183935 - DNA, 3488 bp, Homo sapiens
  Payload ID: 16247
  Gene Symbol: SLC37A3
  Gene Name: solute carrier family 37, member 3
  ENST ID: ENST00000477571
  CDS Start-End: 145-819
aggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgagacggggtgtcaccatattgctcaggctggtctccaaatcctgagctcaaacgatctacctgccttggccttccaaagtgcgagccaccacacctggccctcttgtggtcttaaaggaaaggggaggagggcaggtgaagaacagaaatgccacatgtcatatttagtaggacaccagcaagtggagccatgctgcagcttcattttccccaaagctgaaacttcaaaggcaaatgacaacaacccaatccaggcaagactgctaaaggcttagacccttcaagaatgaaggtttgggtgatcccaccagtcaggaggccatgacccgctgaggtgcttgctgaggacaaaggaaatgaggaatgggtggtggcaggctcccgtcatcagtgtggatggcagccatgcctgcagctactctaccttcccctgatcctccttcagcttctccaactcctgggccagatggggcagctccatgacaatgggcactggcttcttcaggacatccagaccctcaaggtcaggggcagtgagactgacacaggttccagttcatgctgctcggttccagcttgtgcttgcaggttacaggctgtcctgctcttctctatttatatccatttccctcctaaccacctgccctgtgaacttaactctctagcatcagacatcccatccaggaggagaacatacacacagttgtttaactagcctcacaattactaagatcaaatttgcacaacaaatacacacacacacagagaaatatgtatcctaatgggtctgcctctctgattaaacccttaattgatacactcattctgtggacatcattcagtcctttttctccagccactccgtccttgctcagtgaactcacaaacaaaggggacatagcagcagcaatagaagggatgcaagggcttagtagcctggtcttctaccctccaagcctgaactgacaacagatcacagcccatactgaggccctaatatggcactattccccaagaggaccaatcagctgcctggtggcaggttaattacatcaggtcacctccattatgaaagaggaagtgctttgtacttgctggaatagacacttactatggacatgaattttccttccctacccacaatacttctgccagagccacagtaagtggacttacagaatgccctacccaccgtcaaggtaggccatatggcattacttctgaccaaggaagtcatttcatagcaaattaagtggatcagcgggctcctgctcatggagtttactagtcttaccgtgtttcccaccaccctgaagcagctggcccaatagaacaatggaatgagcttttgaagattcacaggaccagctaccatctaccatccctataaggatgacgacaccttatagagctggtgtatgatctatgctttttttttctttcaagtttaacctgataatttatttgtggggaaaaagctagttttgatgagaaaaagttgtcctttccttgtaaacacaaagaaactcaacaggaattttaaatgttatagtaggccagaaaatgcaacagtaactcttacaatccttttcaattaaacagacaaatcaagttgaagacaaatgttaaaatactatttagcccaaatatttatcagcgtatatatcctgttgttcaattggcttttgatttaaaaaccaaacagacaaaccaacaaactttataagagctacactggctgggcgcggtggctcatgcctgtaatcctagcactttgggaggccgaggcaggcagatcccttgatgtcaggagtttgagaccagcctggccaacagggcaaaaccccggctctactaaaaatacagaaatattagctgggtgtggtggcacatgcctttaatcccagctacttgggaggctgaggcaggggaatcacttaaacccaggagatggaggttgcagtgggccaagatcgtaccactgcactccagcatgggtgacaaagcgagactccctctcaaaaaaaaaaaaaaaaa

SEQ ID NO: 183936 - DNA, 570 bp, Homo sapiens
  Payload ID: 16247
  Gene Symbol: SLC37A3
  Gene Name: solute carrier family 37, member 3
  ENST ID: ENST00000485538
  CDS Start-End: 1-296
gttctgctatttctgcggacttgggtcgccaggagctcatccaaaggagcagtgaagctttggccactgtcacaggaattgtggatggttcggggagcattggagctgcagtgggccaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagat

SEQ ID NO: 183937 - DNA, 551 bp, Homo sapiens
  Payload ID: 16247
  Gene Symbol: SLC37A3
  Gene Name: solute carrier family 37, member 3
  ENST ID: ENST00000492027
  CDS Start-End: 1-244
ttattcaatccaagatgatagttctgttgcccaagtcaaggcgataagcttctaccaggcatgttgccttcctggagtcataccgtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgt

SEQ ID NO: 183938 - DNA, 601 bp, Homo sapiens
  Payload ID: 16247
  Gene Symbol: SLC37A3
  Gene Name: solute carrier family 37, member 3
  ENST ID: ENST00000464834
  CDS Start-End: 1-451
gttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagatatgtaaggaccacctttcacccctctcctccagtatgcctttctggtgacggcgtctgtgcagtttgctggtgggatcgttatcttctttggactcctggtgtcaccagaagaaattggaaaactctgagctccttttagtgagtgaaaggagaacagtactgccgtttgagtcctgtcgacattgtagccagcccctg

SEQ ID NO: 183939 - DNA, 452 bp, Homo sapiens
  Payload ID: 16247
  Gene Symbol: SLC37A3
  Gene Name: solute carrier family 37, member 3
  ENST ID: ENST00000477006
  CDS Start-End: 1-452
gtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctc

SEQ ID NO: 183940 - DNA, 741 bp, Homo sapiens
  Payload ID: 16247
  Gene Symbol: SLC37A3
  Gene Name: solute carrier family 37, member 3
  ENST ID: ENST00000491357
  CDS Start-End: 1-369
ggctggaaggaggcggaagccgacaagctgtccatttggtacgacgttggagggatcatagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcct

SEQ ID NO: 183941 - DNA, 879 bp, Homo sapiens
  Payload ID: 16247
  Gene Symbol: SLC37A3
  Gene Name: solute carrier family 37, member 3
  ENST ID: ENST00000498469
  CDS Start-End: 1-486
ctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctc

SEQ ID NO: 183942 - DNA, 574 bp, Homo sapiens
  Payload ID: 16247
  Gene Symbol: SLC37A3
  Gene Name: solute carrier family 37, member 3
  ENST ID: ENST00000490760
  CDS Start-End: 137-301
agcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcaggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcag

SEQ ID NO: 183943 - DNA, 1792 bp, Homo sapiens
  Payload ID: 16247
  Gene Symbol: SLC37A3
  Gene Name: solute carrier family 37, member 3
  ENST ID: ENST00000469636
  CDS Start-End: 1-171
caaaggagcagtgaagctttggccactgtcacaggaattgtggatggttcggggagcattggagctgcagtgggccagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacg

SEQ ID NO: 183944 - DNA, 647 bp, Homo sapiens
  Payload ID: 16247
  Gene Symbol: SLC37A3
  Gene Name: solute carrier family 37, member 3
  ENST ID: ENST00000469193
  CDS Start-End: 188-647
ggaaaccctggtcgcaccgccaggggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtgtatgcctttctggtgacggcgtctgtgcagtttgctggtgggatcgttatcttctttggactcctggtgtcaccagaagaaattg

SEQ ID NO: 183945 - DNA, 578 bp, Homo sapiens
  Payload ID: 16247
  Gene Symbol: SLC37A3
  Gene Name: solute carrier family 37, member 3
  ENST ID: ENST00000485734
  CDS Start-End: 1-578
ttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtctatttagtgtctctgatccgggacaagctaggatggatgtgggttttctactttttcattctcatgacaagttgtacaattgtgtttatctcgccattaatagtgagggaaatatt

SEQ ID NO: 183946 - DNA, 551 bp, Homo sapiens
  Payload ID: 16247
  Gene Symbol: SLC37A3
  Gene Name: solute carrier family 37, member 3
  ENST ID: ENST00000462881
  CDS Start-End: 134-334
ggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagtagagacggggtttcaccatgttagccaggatggtctcgatctcctgatctcatgatctgcccgcctcggcctccccaagtgtggggattacagatctggagcagcaaccatttgttccccagtgcagagaaagcgactcttttcctcggcacactggataccattttcctcttctcctatgctgtgggcctattcatcagtggcatcgttggggatcgg

SEQ ID NO: 183947 - DNA, 538 bp, Homo sapiens
  Payload ID: 16247
  Gene Symbol: SLC37A3
  Gene Name: solute carrier family 37, member 3
  ENST ID: ENST00000484416
  CDS Start-End: 1-378
ggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagatatgtaaggaccacctttcacccctctcctccagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagcc

SEQ ID NO: 183948 - DNA, 534 bp, Homo sapiens
  Payload ID: 16247
  Gene Symbol: SLC37A3
  Gene Name: solute carrier family 37, member 3
  ENST ID: ENST00000485861
  CDS Start-End: 1-534
gtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtactcactggcctacgcctgcttgaagttagtgaattactccttcttcttctggctccccttttatctgagtaacaacttcggctggaaggaggcggaagccgacaagctgtccatttggtacgacgttggagggatcatag

SEQ ID NO: 183949 - DNA, 8066 bp, Homo sapiens
  Payload ID: 16248
  Gene Symbol: SLC38A1
  Gene Name: solute carrier family 38, member 1
  Uniprot ID: Q9H2H9
  ENST ID: ENST00000398637
  CDS Start-End: 696-2159
gcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcagatatttggatatgaatacctaacctagccatatccatggccatctctgttcttttcagcaatgttttccatattatattagcaatgacagaaacagaacaagccaagatccagtcagttcttgggagcttgtctagagcaccaagtaatgaaatagccaggtagtgggatgactgtacctttaaaaatacataatttagtttgcaagctatattatgctactttctattttccttgttactttatagcaattcattttaccctcacaaagtcaatttagaaccttatcattaactgggatgtgtagtgatatttttgggcctctgggtttcatgtgtcaatacaaggaatatttatttaaaatagatttatttagaggaggcacagtgttgttgatctgtgtgacaccacccatatttttaaaaacctttgtatgtttctctaaatttgttgttgactgaatataatagaccctaccataattcgtcaaatatcactgattagttacatcctttgtgtgagattagctgtaaagtatactgctcttattcttattcagaatagttaattggtagccaaaaatacatgtatcacagatgttaggtcgaatttaaacagcacagtcaagtgctatggaagtttttctgctaaattagtagattaaagaatactataccctaggcatggggagcagcacgttttcctttggtaggtaggatctctatactagtgaacagtgccagttccacactttggacttagaactgttctctagttattgtaacacagaatactgtcaatccctaatttacttaatgttacttattggaagtggggctgatgaaatacgcacaggagggaaatctactgtgtttaggcacaggcagccccagtgtataaggagatcatattccaaaaggttgtcagttggttgtttgcaacctggaatgtattttcctttagagaccaggttatccatggtggttaggcccctagagcagctggaaaagatgatcaaaccaataggttagctgacatcgaataatgtaataggtttgctaaagaatctaaccatcaaatataatattgtttccagggagggtgtttgttcagagttgcctgttagtagaatctggactgtccatcccagccacatcccacctactggacagtaggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaagaaattaaaataaaagaccctttgtaaatgcagacttagaagaaatactgaatttgtgtcagaagttctccagtgtttgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttttatctaaggaagggctatgaaactgggcccatctgtatacaggctcaaatttacgtttttaaaggaagaatctatgcagctgaggcttattgcaggaaatacttcatttgtatgtaaatattattgtaaataaataggaggctgtatatttttgaagttgttgatctgcactgaaatagaagtctctaggatctgcatataaacaataaatgtttcctagaaattagtggttttgtttgggaattagaaaaatttacattctctcccaggtaacatagttctctcaatgtaaacttggaacctgaaaccctacttaatttagagaaagaaatgtctgagaaatagttcccttgatttcttatgctggcattaagatcaattatttaacagatagtcctctgagatacaagtaaggaatatttagacacaaatccttgtcctatagaaacagatatacccaaatgacaaattgtttcttcataatgatcttccatttttaacactgataccactacacagtacatatgaaaacagaagctggggagaagaatgtttttttcacaattgaattgctgcatttctcaaactttgggatctatgaaagcggggagagggaacctgaatattaattatgagcacaaatttgaaggaaagaaaacaaagaaccattatctaatcaagctttgaaagtcctgcatgtttgccttttattttagtgttgacgccaacatagactgtctaaggtatttttttccccaaacacttgaatcttggtcgttggtatgtaatccactctctagagtccagtgtactttagacttcatctgagtccaatacatgtaccacactactgttttattaatgtaaaaaccttgtaaatgaatttcagatgggtgatttaagtgagtcacaagtcacaaaactttgctattcatagttaatcaaatagaactgggttttttttttcagagtgtggtgtaaataaagaaatataagaagttctgttctataactgctctgttaacatagtttttaaacattaaaaaatgtgaactaaaagta

SEQ ID NO: 183950 - DNA, 3436 bp, Homo sapiens
  Payload ID: 16248
  Gene Symbol: SLC38A1
  Gene Name: solute carrier family 38, member 1
  Uniprot ID: Q9H2H9
  ENST ID: ENST00000439706
  CDS Start-End: 804-2267
agaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggagagtcaaggaaacttttgagctatttacagcttgtagcaattatgtaaagtatactcctctgaacaaaatttggagcatgtttgtttctctctacctgatttccccagaatctggaaactatctatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 183951 - DNA, 2332 bp, Homo sapiens
  Payload ID: 16248
  Gene Symbol: SLC38A1
  Gene Name: solute carrier family 38, member 1
  Uniprot ID: Q9H2H9
  ENST ID: ENST00000546893
  CDS Start-End: 464-1927
gcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgta

SEQ ID NO: 183952 - DNA, 3196 bp, Homo sapiens
  Payload ID: 16248
  Gene Symbol: SLC38A1
  Gene Name: solute carrier family 38, member 1
  Uniprot ID: Q9H2H9
  ENST ID: ENST00000549049
  CDS Start-End: 564-2027
accgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtg

SEQ ID NO: 183953 - DNA, 891 bp, Homo sapiens
  Payload ID: 16248
  Gene Symbol: SLC38A1
  Gene Name: solute carrier family 38, member 1
  ENST ID: ENST00000550173
  CDS Start-End: 657-891
agttgcccctgctcccctccatgccgctccctcgtcccccggacttggagcgccccagctccgttaacctggacgcaccaggtccttcggtcgggaccacgtggggtctccaggccctccaagagctggcccccggctctttgcgcctaggccggtgctttctcggtgctcagcaaatccttctggttcacctcacacccagtccccaaagcagagctccacagggcagatctcaggaagggctgaccaggtctgcgggtgctggatccggaagaggggaggtgcctcccgcttcagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgttttta

SEQ ID NO: 183954 - DNA, 2599 bp, Homo sapiens
  Payload ID: 16248
  Gene Symbol: SLC38A1
  Gene Name: solute carrier family 38, member 1
  ENST ID: ENST00000552197
  CDS Start-End: 686-2197
gttgccgcagaggcctttaaacgcgtgggtcggtgccgggaggagagcgcatcttcgcccttgtgcgagccccttgccccctaaattatccacctcctggcgcatggggctccccagcacccactgggacccagtaggttacccggctgcctgggcaccgtttgcctgccaaatcgcccgcctgaggtttgtgctgaactgtagttagagaaggcacaagtgcatatggcagcaaaaggaatttcgcggtacccgcgtcacgccgctcccagtgcctttcacaggctgccttgggctggggaaggtggtgctacaattcagagtcctttgtcttgctctgcggcgcggacccggggtttgtacaaaccctcgttctctgttagaaacctaactgccgccaggatcacgtactttctcggacgaatccgcggtgatgtgtgtagcaaaagtgaaaaaagacgcctctgctagaaaacgatatttattgagtgtctactgtgtgccaggcactatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggctctttctcttcctccagtttccagtccagccctgttggctctcagaatgcatcatccttctccctgcagcgctctcactgaacatgctcaagcgcaaggaacttataatcttgtgttctctggattctggatttagtaatctgtattagtctgttctcacactgctaataaagaaatacctgaggttgcttccaagatagccaaataggaacagctctggtctgcagctcccagcaagatcgatgtagaagatgggtgatttctgcatttccaactgaggtacctggttcatctcactgggactggttggacagtgggtgcagcccatggaaggtgagctgaagcaaggtggggcgtcacctcacccaggaagcacaaggggtcaggggatttacctttcccagccaagggaagccatgacagactgtaactggagaaacggtacactcctgaccaaatactgcacttttcccacagtcttagcaactggcagaccaggtaataccctcccgtgcctggctcagtgggttccatgccaacggagccttgct

SEQ ID NO: 183955 - DNA, 1607 bp, Homo sapiens
  Payload ID: 16248
  Gene Symbol: SLC38A1
  Gene Name: solute carrier family 38, member 1
  ENST ID: ENST00000612161
  CDS Start-End: 96-1607
aggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttggctctttctcttcctccagtttccagtccagccctgttggctctcagaatgcatcatccttctccctgcagcgctctcactgaacatgctcaagcgcaaggaacttataatcttgtgttctctggattctggatttagtaatctgtattag

SEQ ID NO: 183956 - DNA, 2708 bp, Homo sapiens
  Payload ID: 16249
  Gene Symbol: SLC38A10
  Gene Name: solute carrier family 38, member 10
  Uniprot ID: Q9HBR0
  ENST ID: ENST00000288439
  CDS Start-End: 347-2689
gtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtca

SEQ ID NO: 183957 - DNA, 4300 bp, Homo sapiens
  Payload ID: 16249
  Gene Symbol: SLC38A10
  Gene Name: solute carrier family 38, member 10
  Uniprot ID: Q9HBR0
  ENST ID: ENST00000374759
  CDS Start-End: 385-3744
aagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 183958 - DNA, 896 bp, Homo sapiens
  Payload ID: 16249
  Gene Symbol: SLC38A10
  Gene Name: solute carrier family 38, member 10
  ENST ID: ENST00000540966
  CDS Start-End: 1-896
ggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggctgaaattaaaaagatagtagcagaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggct

SEQ ID NO: 183959 - DNA, 528 bp, Homo sapiens
  Payload ID: 16249
  Gene Symbol: SLC38A10
  Gene Name: solute carrier family 38, member 10
  ENST ID: ENST00000539748
  CDS Start-End: 172-528
cgcgactgcccatccaaaccgaggcctcgcggggcgagtcccttgtcctccagctcgttgaactggggccccgggcacaggtcggctggaccagcttggcgaaccggacagctgcgagaccctcagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtg

SEQ ID NO: 183960 - DNA, 663 bp, Homo sapiens
  Payload ID: 16249
  Gene Symbol: SLC38A10
  Gene Name: solute carrier family 38, member 10
  ENST ID: ENST00000543204
  CDS Start-End: 1-211
gcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcggctctgtaaatgtggatcgggctcttccataattccagcagcattaccttctccaccaaaatgacaagagcgagtgattcgtgcccggttggaacatggtaaccggctgaaaagagaggcgtaaatccggcgcagacgggaaaagaccatcggcatgcggggggctggcagagcggcccctgtagcgttagtgggcatgcattgagccaatcgtaaactaatgtgacagatgaaatttgttcataccgctgtgtttacacccacatgcgagatccaaatcgtcatttcccacttagcgtctctcttggcagctccatctccaccagaacgcgccccagtcttgctgtttaatatcccattatgatcggtgacagaagccgcattcttccgccacgtacctagttaccagttgccctttgtgtctgcgtgtttgcatatttagaaataaatctgcagctggg

SEQ ID NO: 183961 - DNA, 774 bp, Homo sapiens
  Payload ID: 16249
  Gene Symbol: SLC38A10
  Gene Name: solute carrier family 38, member 10
  ENST ID: ENST00000576151
  CDS Start-End: 1-774
gggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaa

SEQ ID NO: 183962 - DNA, 3737 bp, Homo sapiens
  Payload ID: 16250
  Gene Symbol: SLC38A11
  Gene Name: solute carrier family 38, member 11
  Uniprot ID: Q08AI6
  ENST ID: ENST00000303735
  CDS Start-End: 332-1486
agaaacatcctgcagcatctccgtctccggaggaaaaatacatttgtctgggcgaactccggtggaaaagcgccccaggctgccacagcctagagatcttggggctgcagccctcgcggcctgccgagggagcagggggcgcccgtggaactggctccctgcagctctgcggctacacgcggacctcggctgtgtgcgaggtggcggaggaggctggccgggtgcgaatccgtacccagccccagcatcttccacctgctgaggaccaccgctcagccatgggctaccagaggcaggagcctgtcatcccgccgcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggcttttatcaagacttggcttttatgagtagtgcaatataaaagataaagaaaagaaaaattgaatgtatttcacctttaactggaacaaaataagggttttgttctaatgactgcactacactaatgctaattgaagaagggagagttaagcctttagcattttctgccatcccccttttatttaatatgcaaaccagtatattgtgctccaaaataagtaggtgattgtgggttggaattttgtgtagatgtcttttggtgggggggtgtggggggtgggcattttctttgtccttaaaagtctgtggaactgaagagaagggaaacccaaaacgattgaaaagaagacatatcccaagaacaaagaggagctctccgttataatttcagcagcatcctttgtttaaagggaaatggatccctggagaaatgagcaaagacctctccatgtgaggaatcctgaatcatagactggctgtgaggagcaaggtgtgtaaagaatcaaaatcacctcccatcttctgatgctgtgggaatacaatggtagcaccattctaaaacagaaaaacaaacaaacaaacaaaaaaaacaaaaacaaaaaacagttgttctgtggcaagaacctaagagattggtgatatggacctgttggatttttagtgctgtcaggaatgtacaactggaagctgaactttgaaactagaaacgtgtaagaagaatcagggctacagaagaagctttctcagtccactgggggttcctcagagagatttctgggagctcttgttgactgggtctttgggagcagatagtgagatggagtttatcataactaatgggagagaggggaaagcaggattgttagggagaggtagaactgcagtgcaggctgacctcagccaaatccacagggaagctggtgcatacatgacccatcagagttgtccctgttcaagggtaatagcccagttttgatactgctgcctccatcagtcatttaatgtgagcatctggagaaggatgagttcttgggctaggcagctctttgcagcagagcaaaccctaaaggaactgagagctcgaggtggtctactgatagctttgtcaccacatgcttccttacaggggtatctgggagacacagctgtgcccaccacagatgccctcggtttactgaggatttttaaatgattttttaatgaggactttgtgtctttgtatgtatgacaatcttcaaaaagtaacatgaaaatctggggccatctggatggcttccttatatcaagtatcacctaagattttcatttcatttgtattccaatcaggttgtccatctgtggcactatattaattgttgccaaataacgagaaactatcacaagcagagttaatacatatatgatgagtttgtacaaatcaaatgcaaaaagaaatcctacaggaagtgtataaagggtaggttcacagtagtttgaataaagtggcaagagctgagtcactgtgtgactcatagtgagaaaggcctattgaacataaaggaagatgcattttagcaggtagaaccatgctcagggttttagtggtgatttattttttcaataaaatattatccttaccattaaattaatttaaattctgttgggtaacttttctgtatttaacttataaatttgtttttttatagttaagggtcataggctaagcagtttgtgcctgtttttagattggtacatgtttaggtaaaatataataaaaatgctttcattccatgtaagaaatgaggaaatgtaagaaatttttgccacagtctgtcattacattgctcaagactgagaaacactgacctacataattattaaataaagtcatgagggatgagatctctaagcatgtacaaagaaaagtatgtcaaggataacataatttagcacgtaaccatctcttatcttgtactttggtgttgcttcatactcttcaagtagatgaaagctcctggtaggaactgagcgcagcattagtgcctaataaacatgtattggtttatttatttttaatcagctgtagaacaagactgcttatgacccagttattagctgcacggattaccgacatctttcaaattataatttaataaatcttaggaactca

SEQ ID NO: 183963 - DNA, 1621 bp, Homo sapiens
  Payload ID: 16250
  Gene Symbol: SLC38A11
  Gene Name: solute carrier family 38, member 11
  Uniprot ID: Q08AI6
  ENST ID: ENST00000409149
  CDS Start-End: 293-1513
acatttgtctgggcgaactccggtggaaaagcgccccaggctgccacagcctagagatcttggggctgcagccctcgcggcctgccgagggagcagggggcgcccgtggaactggctccctgcagctctgcggctacacgcggacctcggctgtgtgcgaggtggcggaggaggctggccgggtgcgaatccgtacccagccccagcatcttccacctgctgaggaccaccgctcagccatgggctaccagaggcaggagcctgtcatcccgccgcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggctttta

SEQ ID NO: 183964 - DNA, 1542 bp, Homo sapiens
  Payload ID: 16250
  Gene Symbol: SLC38A11
  Gene Name: solute carrier family 38, member 11
  Uniprot ID: Q08AI6
  ENST ID: ENST00000409662
  CDS Start-End: 259-1479
tgggctaccagaggcaggagcctgtcatcccgccgcagagagatttagatgacagagaaacccttgtttctgaacatgagtataaagagaaaacctgtcagtctgctgctctttttaatgttgtcaactcgattataggatctggtataatagtagccccattttgactccagagtctgtctttcttaatattccataacccttctgtgctccttattatcctctctgctttcttggctagcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgc

SEQ ID NO: 183965 - DNA, 1647 bp, Homo sapiens
  Payload ID: 16250
  Gene Symbol: SLC38A11
  Gene Name: solute carrier family 38, member 11
  ENST ID: ENST00000409058
  CDS Start-End: 231-1544
tgggcgaactccggtggaaaagcgccccaggctgccacagcctagagatcttggggctgcagccctcgcggcctgccgagggagcagggggcgcccgtggaactggctccctgcagctctgcggctacacgcggacctcggctgtgtgcgaggtggcggaggaggctggccgggtgcgaatccgtacccagccccagcatcttccacctgctgaggaccaccgctcagccatgggctaccagaggcaggagcctgtcatcccgccgcagagagatttagatgacagagaaacccttgtttctgaacatgagtataaagagaaaacctgtcagtctgctgctctttttaatgttgtcaactcgattataggatctggtataatagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggc

SEQ ID NO: 183966 - DNA, 452 bp, Homo sapiens
  Payload ID: 16250
  Gene Symbol: SLC38A11
  Gene Name: solute carrier family 38, member 11
  ENST ID: ENST00000424914
  CDS Start-End: 1-452
ctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtc

SEQ ID NO: 183967 - DNA, 4888 bp, Homo sapiens
  Payload ID: 16251
  Gene Symbol: SLC38A2
  Gene Name: solute carrier family 38, member 2
  Uniprot ID: Q96QD8
  ENST ID: ENST00000256689
  CDS Start-End: 446-1966
gatacacaaagagaaggcgcccgggcggccgcggtcccgcccactgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctg

SEQ ID NO: 183968 - DNA, 4384 bp, Homo sapiens
  Payload ID: 16251
  Gene Symbol: SLC38A2
  Gene Name: solute carrier family 38, member 2
  ENST ID: ENST00000549258
  CDS Start-End: 350-616
agccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttaattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatga

SEQ ID NO: 183969 - DNA, 2802 bp, Homo sapiens
  Payload ID: 16251
  Gene Symbol: SLC38A2
  Gene Name: solute carrier family 38, member 2
  ENST ID: ENST00000551374
  CDS Start-End: 42-1076
atgtcttttttgtgtgtttgttttcatggtattcctatgaaatgagtcctgttagaagatgtgtatatttttcagaggatatttgtgactgttttgaccttgtttctgttttctttagattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaa

SEQ ID NO: 183970 - DNA, 1221 bp, Homo sapiens
  Payload ID: 16251
  Gene Symbol: SLC38A2
  Gene Name: solute carrier family 38, member 2
  Uniprot ID: Q96QD8
  ENST ID: ENST00000612232
  CDS Start-End: 1-1221
atgaaacagaatttaattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaa

SEQ ID NO: 183971 - DNA, 584 bp, Homo sapiens
  Payload ID: 16252
  Gene Symbol: SLC38A3
  Gene Name: solute carrier family 38, member 3
  ENST ID: ENST00000610458
  CDS Start-End: 297-584
atcccgcgtcgctgttgtcgctgttgcagccgagttcagccgggagcagagcgaaccgcaccggcccgagcggagcgccgcacgttcccaaccgcgaggccaggtggggtctcactctgttgcccaagctggagtgcagtggcacaatctcgcctcactgcaaccgccgcctcccaggcccaagcaattctcccacctcagccttctgagtagccaggaccgcaagtgtgcaacatcaagcctggacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcatt

SEQ ID NO: 183972 - DNA, 880 bp, Homo sapiens
  Payload ID: 16252
  Gene Symbol: SLC38A3
  Gene Name: solute carrier family 38, member 3
  ENST ID: ENST00000445096
  CDS Start-End: 233-880
cgggagcagagcgaaccgcaccggcccgagcggagcgccgcacgttcccaaccgcgaggccaggttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacaacggggtggagtcggagctgctgcacacctacagcaaggtggacccgtttgacgtcctgatcctgtgtgtgcgcgtggcc

SEQ ID NO: 183973 - DNA, 2978 bp, Homo sapiens
  Payload ID: 16252
  Gene Symbol: SLC38A3
  Gene Name: solute carrier family 38, member 3
  Uniprot ID: Q99624
  ENST ID: ENST00000614032
  CDS Start-End: 155-1669
atcccgcgtcgctgttgtcgctgttgcagccgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgttcctgttgacagctgtcgccttgctctccagctactccatccacctgctactcaagtcctcaggggtcgtgggcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacagacagcatacaccatccccatcatggccttcgccttcgtctgccaccccgaggtgctgcccatctatactgagctcaaggacccctccaagaagaagatgcagcacatctccaacctgtccatcgctgtcatgtacatcatgtacttcctggctgccctcttcggctacctcaccttctacaacggggtggagtcggagctgctgcacacctacagcaaggtggacccgtttgacgtcctgatcctgtgtgtgcgcgtggccgtgctgacagcagtcacgctcacagtgcccatcgttctgttcccggtgcgccgcgccatccagcagatgctgtttccaaaccaggagttcagctggctgcggcatgtgcttattgccgttggcctgctcacttgtatcaacctgctggtcatctttgcccccaacatcctgggcatctttggggtcatcggtgccacatctgccccattcctcatcttcatcttccctgccatcttctacttccgaatcatgcccacggagaaggagcctgcaagatccacccccaaaatcctggccctgtgttttgctatgcttggcttcttgctgatgaccatgagcttgagcttcatcatcattgactgggcctcagggaccagccggcatggaggaaaccactagggtgaccctcatcctgttctgtctactcaccctagcagccctgcccagactcttcagcccctgctcccatccagtggccagtcgggggaggagaaagacgcgattaacactgtggcattcagccaggccccatgtcctctctgtggaaggtttttgttcaagagccaggaccaaggcccttgggccactaccctgctaggctctggagctgtagaggcttcctgaactgggagcagggtagggctgtcgccttagatcccgcccaagcccctcattccctccttgcacagatgcatacactggggcccagcagctgcctcctgaggtgacacagcctgtaggaacatacacagctgggatcagcctgcagccatcccccgaccctgctgctaggccacggtctgcgccctggggcctcatctcccccagcccacttgttttccccccttttattccctaggcccttttcagactcctgggcccttggatactcttctcccatctcccttcacaggatgacaccctcccataccccatagctggggccagcaggttctgctgagggtggggctggtgtagggacccccaagagacccctgtcctgtcccttcaccagtcctggggaggctgggactccccctgccacaagcctgggccacagctcacattccactgctgggagaagaaacaggccgaggcccagagtggcctgcccccgggagccaaagaccccagtggccacactgggatagggtggggaggctggcagccctcttttataaatattatacataagaccagctgtgttttctattcttggtctccatggtccctggattcctggaaagtgaggtacgggccagaacatggatggtgatggagggcccccgtctccttgtctgggatgagggtggggacagggcaagtcccccacccaccccaccccctgcctcccaaactaaccagtggcacactcagacccagctctgggcctgggccaggctcagcacagacctgctttctcacgggttgaggtggggaggaattaatgaggccccaggaagtgggacagagagaggcctccggaaggaggcaacgtgaggtgcatccccagcagcttcagggagggtctgagctgggggcagctgagccctgagggagccccaggaagggccccctgccctcccctagctcccaggctgccatgtcaactctctgtcaatgccctgagtctggggacaaaagtccaggaatcctgtgccctgttgggctgatctttttatcaacagtaaaatccactacgaataaa

SEQ ID NO: 183974 - DNA, 992 bp, Homo sapiens
  Payload ID: 16252
  Gene Symbol: SLC38A3
  Gene Name: solute carrier family 38, member 3
  ENST ID: ENST00000621714
  CDS Start-End: 133-447
gttgcagccgagttcagccgggagcagagcgaaccgcaccggcccgagcggagcgccgcacgttcccaaccgcgaggccagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcctgcatccgtgcctatgagcagctgggctaccgtgcctttgggaccccaggaaagctggcagcagccctggccatcacgctccagaacatcggagccatgtccagctacctgtacatcatcaagtctgagctgccacttgtcatacagaccttcctgaacctggaggagaaaacctcggactggtacatgaacgggaactacctggtaatccttgtctctgtcaccatcattctgcccctggcactgatgcggcagcttggctacctgggctactccagcggcttctctcttagctgcatggtgttcttcctaattgcagtcatctacaaaaagttccacgtgccctgcccactgccccccaacttcaacaacaccacaggcaacttcagccacgtggagatcgtgaaggagaaggtgcagctgcaggtcgagcctgaggcttcagccttctgcactcccagctacttcacgctcaactcacagacagcatacaccatccccatcatggccttcgccttcgtctgccaccccgaggtgctgcccatctatactgagctcaagg

SEQ ID NO: 183975 - DNA, 635 bp, Homo sapiens
  Payload ID: 16252
  Gene Symbol: SLC38A3
  Gene Name: solute carrier family 38, member 3
  ENST ID: ENST00000621456
  CDS Start-End: 337-635
tgaagggtaggcctttgactctgggtggtaggacagacataggagaacagggtggggctctagaggaccaggcggggcttctgggggccaaagggaaggaccagctgctgggcaggaggggctttccggccagtggcctggggtggcttggttttgaatttccgctctgcgggccacgtcctgtacacagcctctcagccagcacgtctgcacacgtgcatggctgctgggaatgggggtcactccgactgaccatcatctccacatgtattttccattgctcagacatctgactgttggtgtgagaccagtgctcctggtggtgtgccctgagccatggaggcgcctttgcagacagagatggtggagctggtgcccaatggcaaacactcagaggggctgctcccggtcatcacccccatggcaggcaaccagagggtcgaggaccctgcacggagctgtatggagggcaagagcttcctacagaaaagtcccagcaaggagccacacttcactgacttcgaggggaagacatcattcgggatgtcagtgttcaacctcagcaatgccatcatgggcagcggcatcctgggactcgcctatgccatggccaatacgggcattatccttttcct

SEQ ID NO: 183976 - DNA, 2728 bp, Homo sapiens
  Payload ID: 16253
  Gene Symbol: SLC38A4
  Gene Name: solute carrier family 38, member 4
  Uniprot ID: Q969I6
  ENST ID: ENST00000266579
  CDS Start-End: 400-2043
actggggtgtgcgcagcgcctggagcatgagccgggtggtggcgtgcacggaggatcgcgggaggctgccgcctcgggacaccccactcacacagagctgacgcaagttggacagaaggaggtgttggggtgaggtggtggtgttgattggcttgtctcgttcactcccactggtctttaaatcaatgtctagatctctaaagtttcatataaatcaaagctgttacacgggtctgccattccaaacaagtcaggaaagcctgcacaggactggataaataattaagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgaagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagaga

SEQ ID NO: 183977 - DNA, 3791 bp, Homo sapiens
  Payload ID: 16253
  Gene Symbol: SLC38A4
  Gene Name: solute carrier family 38, member 4
  Uniprot ID: Q969I6
  ENST ID: ENST00000447411
  CDS Start-End: 208-1851
actggggtgtgcgcagcgcctggagcatgagccgggtggtggcgtgcacggaggatcgcgggaggctgccgcctcgggacaccccactcacacagaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttaggttatcttggctataccagtggattttctcttacctgcatggtgttttttgttagtgtggtgatttacaagaaattccaaataccctgccctctacctgttttggatcacagtgttggaaatctgtcattcaacaacacgcttccaatgcatgtggtaatgttacccaacaactctgagagttctgatgtgaacttcatgatggattacacccaccgcaatcctgcagggctggatgagaaccaggccaagggctctcttcatgacagtggagtagaatatgaagctcatagtgatgacaagtgtgaacccaaatactttgtattcaactcccggacggcctatgcaattcctatcctagtatttgcttttgtatgccaccctgaggtccttcccatctacagtgaacttaaagatcggtcccggagaaaaatgcaaacggtgtcaaatatttccatcacggggatgcttgtcatgtacctgcttgccgccctctttggttacctaaccttctatggagaagttgaagatgaattacttcatgcctacagcaaagtgtatacattagacatccctcttctcatggttcgcctggcagtccttgtggcagtaacactaactgtgcccattgtcctcttcccaattcgtacatcagtgatcacactgttatttcccaaacgacccttcagctggatacgacatttcctgattgcagctgtgcttattgcacttaataatgttctggtcatccttgtgccaactataaaatacatcttcggattcataggggcttcttctgccactatgctgatttttattcttccagcagttttttatcttaaacttgtcaagaaagaaacttttaggtcaccccaaaaggtcggggctttaattttccttgtggttggaatattcttcatgattggaagcatggcactcattataattgactggatttatgatcctccaaattccaagcatcactaacacaaggaaaaatactttctttttctattggaaatggttacaagttatactccaaaagatatttgaattatcttgattggaatgttattcataggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaacaaaaatgccctggtggcaaagctatcaccatttaatgtcttctctcagtcttgcaccaaagtctctggtctgtttactaacagaggcaaaaggcatgtcttaggaactgtttctgtttctgtaaggtacatgaatggtcaaacaccagtctagagcatcttattgtcaacagcaaaataatattttgcccaccctgtttgtgacattgagttgtgacttctatattcaatagatttttgtaaatgttaaaacatctatatttaaatgttaaaacactaaatatagagaggggctttatttcaatcatagagcaacaacaaaaataatgcttatagctaaactgcctgttctagaaagcatctgctttttcatgttattcctaaatcctcttgtcatacttttgtcattgaacaatgctctccctctcgtcttccatcctcattcagaatttttagaagaccacaatcgtggagatacactacccagtattgtttgatacatttttatttgataaacattcagtgcaggaaactgtgatttgctatatgtttatgtatataatcttattctgtagtcatcagaatgttaatgtaaggtacatttgatttttattttttacatgtgtagttttctttcttcacagtcaaagcatttatattattgggggtgggggcagggaattaagttggtgggctcgaaaatccattcatatgtatctgtctacaaatgtctggggataatttaaatttgaaacctaagttatatatagtttggcaatgctcttcttcaatatttacaataataggatgatctacaagaaaataagtttctttttgcaaatttttatcatactaaagttgttcttttaatttagcatatctaaaataggatttagttcagtttagctcacacaggtgtttgctgacattcattggccatttaatacagtgttgagtggttctctgtaaaagtataagtgctaacactacgaagaaatgcacacgatcattcttgctcacttctataacaaacttacataaaatggatttaaaaattcctactcacagcctaaaacttctggagttcactacctttttttcaaatcatagtaagatcacttgtgtattttatattttagtaaagccaattatgaagtacaagtatcatacacgtacttttgagctactattatttgaaaaaaatctgccaaatagcatctttaggatatatttacattttcactcatctaaaaagtatacaaaaataaaaagtggaaaaaggtatcttctgaatgttcaagagcatcctatagtgccaaataataaagcaccatttttttcttcataaccaggattaaaattcatatatactgcagggcagacatacatatgatagcttgtgctgattaatttaaccccatttgtaaacagatgaaaattttattttcttatttcatttataagatggctcaatgtattgggaggcttcttttttattacagaaagtgtatattggtatataataaatgaacttttcaaatgac

SEQ ID NO: 183978 - DNA, 423 bp, Homo sapiens
  Payload ID: 16253
  Gene Symbol: SLC38A4
  Gene Name: solute carrier family 38, member 4
  ENST ID: ENST00000550670
  CDS Start-End: 1-423
aatacatcttcggattcataggggcttcttctgccactatgctgatttttattcttccagcagttttttatcttaaacttgtcaagaaagaaacttttaggtcaccccaaaaggtcggggaaataacaggaagattccaaagacgtttaccagtaatatcaccaggcacctgcagaagaggaaaatcactgtttttgtcaaggatggttgtgtatgtgtttaaaataaaacctgtggtgcacatttctacccaggttttgctagagcagtgtgagatgatgaaggtgtatttttgctgctttacgagcagaataagggtaactgcatgtaacaatcatcagatagtactctttcccctgccgtctcctcatcctgcaccccctaaaaaagtaccaaacatttgcattctcagaacatcaaaca

SEQ ID NO: 183979 - DNA, 764 bp, Homo sapiens
  Payload ID: 16253
  Gene Symbol: SLC38A4
  Gene Name: solute carrier family 38, member 4
  ENST ID: ENST00000546940
  CDS Start-End: 190-764
aaaagaaagaagggtctctccatccatccctttctgatactttccctgaatcccagtctggaaagggtagtaaaagaggcggagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactgg

SEQ ID NO: 183980 - DNA, 933 bp, Homo sapiens
  Payload ID: 16253
  Gene Symbol: SLC38A4
  Gene Name: solute carrier family 38, member 4
  ENST ID: ENST00000547477
  CDS Start-End: 276-933
gcagcgcctggagcatgagccgggtggtggcgtgcacggaggatcgcgggaggctgccgcctcgggacaccccactcacacagggcaaaaggatgtatacactccatcttcatttaaaacactggaggattggaaaggagaaaaggaacaggacagaaaaaaaaacagagtgttctgaacatcaacacaaagtggaagaaccttaagctgaaggtacagtatattatttacactgaaggggcttgtgtgtggacaagaaagcgctgacagctcaaatggatcccatggaactgagaaatgtcaacatcgaaccagatgatgagagcagcagtggagaaagtgctccagatagctacatcgggataggaaattcagaaaaggcagcaatgagcagtcaatttgctaatgaagacactgaaagtcagaaattcctgacaaatggatttttggggaaaaagaagctggcagattatgctgatgaacaccatcccggaaccacttcctttggaatgtcttcatttaacctgagtaatgccatcatgggcagtgggatcctgggcttgtcctatgccatggccaacacagggatcatactttttataatcatgctgcttgctgtggcaatattatcactgtattcagttcaccttttattaaaaacagccaaggaaggagggtctttgatttatgaaaaattaggagaaaaggcatttggatggccgggaaaaattggagcttttgtttccattacaatgcagaacattggagcaatgtcaagctacctctttatcattaaatatgaactacctgaagtaatcagagcattcatgggacttgaagaaaatactggagaatggtacctcaatggcaactacctcatcatatttgtgtctgttggaattattcttccactttcgctccttaaaaatttag

SEQ ID NO: 183981 - DNA, 708 bp, Homo sapiens
  Payload ID: 16254
  Gene Symbol: SLC38A5
  Gene Name: solute carrier family 38, member 5
  ENST ID: ENST00000416711
  CDS Start-End: 135-708
tttctgagatacctccttcccaaggagtaagcgcgggagggagctggggtttcttcagagacgctgtacctacaagacaggggctccaggctcgggtggggattgcagagacacccccaccccaggaaactcggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgg

SEQ ID NO: 183982 - DNA, 910 bp, Homo sapiens
  Payload ID: 16254
  Gene Symbol: SLC38A5
  Gene Name: solute carrier family 38, member 5
  ENST ID: ENST00000440085
  CDS Start-End: 73-910
agacagcgtgagtctggggtctgggaggagaggctatcccttctccacgtggtcggctcatctgcgctggggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctata

SEQ ID NO: 183983 - DNA, 741 bp, Homo sapiens
  Payload ID: 16254
  Gene Symbol: SLC38A5
  Gene Name: solute carrier family 38, member 5
  ENST ID: ENST00000413668
  CDS Start-End: 86-741
ggccacgcggtgagggtggagggaaggagagggggtggcgcgggggaccggggaatgaaagacacagatggcaagagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaact

SEQ ID NO: 183984 - DNA, 871 bp, Homo sapiens
  Payload ID: 16254
  Gene Symbol: SLC38A5
  Gene Name: solute carrier family 38, member 5
  ENST ID: ENST00000441948
  CDS Start-End: 55-871
cgtctggggcaggggtctccgagtctgtccccaaccctcagctcactcaacaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccacc

SEQ ID NO: 183985 - DNA, 656 bp, Homo sapiens
  Payload ID: 16254
  Gene Symbol: SLC38A5
  Gene Name: solute carrier family 38, member 5
  ENST ID: ENST00000429543
  CDS Start-End: 166-656
ctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggg

SEQ ID NO: 183986 - DNA, 2659 bp, Homo sapiens
  Payload ID: 16254
  Gene Symbol: SLC38A5
  Gene Name: solute carrier family 38, member 5
  Uniprot ID: Q8WUX1
  ENST ID: ENST00000595796
  CDS Start-End: 845-2263
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 183987 - DNA, 2100 bp, Homo sapiens
  Payload ID: 16254
  Gene Symbol: SLC38A5
  Gene Name: solute carrier family 38, member 5
  Uniprot ID: Q8WUX1
  ENST ID: ENST00000619100
  CDS Start-End: 441-1706
ccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctg

SEQ ID NO: 183988 - DNA, 1993 bp, Homo sapiens
  Payload ID: 16254
  Gene Symbol: SLC38A5
  Gene Name: solute carrier family 38, member 5
  Uniprot ID: Q8WUX1
  ENST ID: ENST00000620913
  CDS Start-End: 179-1597
acaaatgccctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 183989 - DNA, 525 bp, Homo sapiens
  Payload ID: 16254
  Gene Symbol: SLC38A5
  Gene Name: solute carrier family 38, member 5
  ENST ID: ENST00000494034
  CDS Start-End: 1-88
ggccctgctgctgtgcattgcgcttctgtcgtcctactccatccacctcctgctgacctgtgctggtattgcagggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccgcgcaggatgcaggccgtggccaacgtgtccattggggccatgttctgcatgtatgggctcacagcaacctttggatacctcaccttctaca

SEQ ID NO: 183990 - DNA, 622 bp, Homo sapiens
  Payload ID: 16254
  Gene Symbol: SLC38A5
  Gene Name: solute carrier family 38, member 5
  ENST ID: ENST00000488083
  CDS Start-End: 132-622
acacaaacaaaccgctgtctccctccaagaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggg

SEQ ID NO: 183991 - DNA, 2100 bp, Homo sapiens
  Payload ID: 16254
  Gene Symbol: SLC38A5
  Gene Name: solute carrier family 38, member 5
  ENST ID: ENST00000622196
  CDS Start-End: 691-1902
ccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgaggggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggcagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctg

SEQ ID NO: 183992 - DNA, 1688 bp, Homo sapiens
  Payload ID: 16255
  Gene Symbol: SLC38A6
  Gene Name: solute carrier family 38, member 6
  Uniprot ID: Q8IZM9
  ENST ID: ENST00000267488
  CDS Start-End: 117-1487
gtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaa

SEQ ID NO: 183993 - DNA, 1730 bp, Homo sapiens
  Payload ID: 16255
  Gene Symbol: SLC38A6
  Gene Name: solute carrier family 38, member 6
  Uniprot ID: Q8IZM9
  ENST ID: ENST00000354886
  CDS Start-End: 165-1730
gtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataa

SEQ ID NO: 183994 - DNA, 1568 bp, Homo sapiens
  Payload ID: 16255
  Gene Symbol: SLC38A6
  Gene Name: solute carrier family 38, member 6
  ENST ID: ENST00000451406
  CDS Start-End: 1-1551
gggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatca

SEQ ID NO: 183995 - DNA, 2501 bp, Homo sapiens
  Payload ID: 16255
  Gene Symbol: SLC38A6
  Gene Name: solute carrier family 38, member 6
  ENST ID: ENST00000491344
  CDS Start-End: 2-328
catggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggcaagaccaacccctcccctgccttcttctcagcctcctcaacatgaagacaatgagaatgaagacctttatgatgatccagtttcacttaatagttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatca

SEQ ID NO: 183996 - DNA, 2787 bp, Homo sapiens
  Payload ID: 16255
  Gene Symbol: SLC38A6
  Gene Name: solute carrier family 38, member 6
  ENST ID: ENST00000525723
  CDS Start-End: 53-274
agggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccagggtctcattctgtcgcacaggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 183997 - DNA, 583 bp, Homo sapiens
  Payload ID: 16255
  Gene Symbol: SLC38A6
  Gene Name: solute carrier family 38, member 6
  ENST ID: ENST00000533744
  CDS Start-End: 1-583
ttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttc

SEQ ID NO: 183998 - DNA, 1689 bp, Homo sapiens
  Payload ID: 16255
  Gene Symbol: SLC38A6
  Gene Name: solute carrier family 38, member 6
  ENST ID: ENST00000527591
  CDS Start-End: 1-63
gcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgatgaacaactaaagcccagagaggtgaagtgacctgtcacagaattaaagacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttccta

SEQ ID NO: 183999 - DNA, 1734 bp, Homo sapiens
  Payload ID: 16255
  Gene Symbol: SLC38A6
  Gene Name: solute carrier family 38, member 6
  ENST ID: ENST00000529345
  CDS Start-End: 1-56
aaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccc

SEQ ID NO: 184000 - DNA, 722 bp, Homo sapiens
  Payload ID: 16255
  Gene Symbol: SLC38A6
  Gene Name: solute carrier family 38, member 6
  ENST ID: ENST00000529212
  CDS Start-End: 1-690
ataattaaaaaatggtccatcccttgtcctctgacattaaattatgtagagaaaggtttccagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataa

SEQ ID NO: 184001 - DNA, 755 bp, Homo sapiens
  Payload ID: 16255
  Gene Symbol: SLC38A6
  Gene Name: solute carrier family 38, member 6
  ENST ID: ENST00000526539
  CDS Start-End: 1-66
attgctttaagttttctcatttattttatatctgcactctttgggtacctcactttttatggataacaggagctttgtgtcataggaagaaattgctggttgaacctgagatcttataagggctagcctcaacttaaggcttccaattcattttacagatgaacaactaaagcccagagaggtgaagtgacctgtcacagaattaaagacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaa

SEQ ID NO: 184002 - DNA, 580 bp, Homo sapiens
  Payload ID: 16255
  Gene Symbol: SLC38A6
  Gene Name: solute carrier family 38, member 6
  ENST ID: ENST00000526105
  CDS Start-End: 201-580
agtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccc

SEQ ID NO: 184003 - DNA, 768 bp, Homo sapiens
  Payload ID: 16255
  Gene Symbol: SLC38A6
  Gene Name: solute carrier family 38, member 6
  ENST ID: ENST00000524402
  CDS Start-End: 1-270
ctctccccactccattcccatcctatcttcatctcttgcagtcacaaggaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctgggaggagatattggtatcttgatggacaaacactactaataatcatatgtgttggcattgtgttccctcttgcacttcttcccaaaataggctttcttggctacacaagtagtttatcatttttctttatgatgttctttgctcttgtg

SEQ ID NO: 184004 - DNA, 555 bp, Homo sapiens
  Payload ID: 16255
  Gene Symbol: SLC38A6
  Gene Name: solute carrier family 38, member 6
  ENST ID: ENST00000528350
  CDS Start-End: 1-173
ttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagcctacttgggcccatgaactaactacttcatggttctgcctgcacattgactcacctgtcttccgttgattgaattccttcaatctttgtaaaattctctgtggagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtaggctttcttggctacacaagtagtttatcatttttctttatgatgttctttgctcttgtggtaataattaaaaaatggtccatcccttgtcctctgacattaaattatgtagagaaaggttt

SEQ ID NO: 184005 - DNA, 640 bp, Homo sapiens
  Payload ID: 16255
  Gene Symbol: SLC38A6
  Gene Name: solute carrier family 38, member 6
  ENST ID: ENST00000534758
  CDS Start-End: 1-128
tacagttggtggtggcaggcaccataataattcagaatattggagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaagga

SEQ ID NO: 184006 - DNA, 4392 bp, Homo sapiens
  Payload ID: 16256
  Gene Symbol: SLC38A7
  Gene Name: solute carrier family 38, member 7
  Uniprot ID: Q9NVC3
  ENST ID: ENST00000219320
  CDS Start-End: 728-2116
ctgattaaaaaaaaactccagtgctctggccatgggcgtgaaggcaaggacagagaccgggaggataatgaggccaaacagctttggcccaccgccaccgggactggcaaagaggccagacctcctaatgctcttccttggaggaaggagcagtgtttgatttggtcaagaggccaagactaaaagtaagaggataaacacgagctggctggacgcgaggctggctcagggcagtgctgtcgggctgaggattcagggagctggtgttgtccaagcttcacatttgcggaaactacaactcccagcgtgtcccgcggccgcccgagcgggcgtcatgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 184007 - DNA, 2867 bp, Homo sapiens
  Payload ID: 16256
  Gene Symbol: SLC38A7
  Gene Name: solute carrier family 38, member 7
  ENST ID: ENST00000564100
  CDS Start-End: 869-1933
cggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaa

SEQ ID NO: 184008 - DNA, 4549 bp, Homo sapiens
  Payload ID: 16256
  Gene Symbol: SLC38A7
  Gene Name: solute carrier family 38, member 7
  Uniprot ID: Q9NVC3
  ENST ID: ENST00000570101
  CDS Start-End: 885-2273
ccccaaggtaggtggccggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatgacatccggacatcctcttccagggactggggcaaactcaggccccacacctctggacagctcaaatccagtccccttcctgctccccagtcctggcagtgccgtggatggcggcaggaagtctcacatcatagaggacccctcctcctctcccagttctcaacttctccatgcctggaatccacgggtgaagagagtcggtagatctcataagaaagaatccagtctgacttccctctggagaatgactatggacagaaggccaccatcctccacagagcaccctgtcctgagtaggggttgtgctcattaccccaggccagtggtagcttcctcaggagcctggccacttccaacggtagcactgaagtcatgcaaatgcatagtcaggtagattcagaccttgtccacaccttcctgggcaacccccaccatgaacctgtcagcctctttcccatagctaatagacatttcccaggccttgaggggccccaccctgtctctttcatcaaacctgatggtccaggctgggcatccctctcctcctccatccccagacatcaccaggtctaatgtttacaaacggtgccagcccggctctgaagccaagggccgtcccgtgccacggtgctgtgagtattcctccgttagctttccccataaggttgggagtatctgcttttgtgtctgagatgggcccctcttttcagaggccgcagggtgggtgatggagaaggctgagaacctttcagaccctctgtgtgggctgggctggtcagaatcagggtgtacctccccgacaccttctttttcagtgatgttttctcttcttcctgcctttcctctgcctcctcccctgccagccctagcgtgactacccagagacaaaaaaaaaaaaaaaaaaaaaaggcagggctgggcgcagtggctcacgcctgtaatcccagcactttgggaggccaaggcgggcagatgacttgaggtcaggagttcgagaccagcctggccaacacggcaaaaccccatctctactaaaaatacaaaaaattaaccgggcatggtggcgggcacctgtaatcccagctacttgggaggctgaggcagcagagccgcttaaacccaggaggcagagactgcaatgagctgagatcgtgccattgcactccagcttgggcaacaagagtgaaacttcatctcaaaaaaacagaaacaaacaaaaaggcagctgggttgtcactgatgggcagcatttgagcctgccacactggcctggaagtttcccttccagtctggattttgtctgctccttccttccccctcaccccgttacctcttcacctcccatctcacttcactgtgtagctcagtctctcccacgcacataattggggacagtgggggctctcttaccagcctcctcagcaacgcacgtccatcaggcctggcctcagtggccagccacattgatgtcacactggaattgttaccccagagagggcgaagagataggctatctccccacctcccaccctactccccactatattcccgttttgaccacctcagcccctcagctgccccctctcactttggccaatcccaggcaccaatcagacttcctcctccacctggagcccctagcatttccttgtcccctcttccccaaaacctctgtaaagggtacgagagggaccccctgccgagccgcccgccactcagggcagtccgatctaagaagcagaagctggttggaggctggctgggcctctgtccagtccccagatggataaactgccttttctcacatcccctcttggtgcctgatcttctctgcccccggggccagacccactgtgctgttttctgtcagtctgtggcacagcaccaagctctgccagcaccagtccctgacagggctaggaggacagcctggtcagcagggctgcagtcccccagtgccgtgtttcgggggtcaagggatgtaagtggagtcattgcacagagacagaccagtcaggagaaggagctggaatctggcctcttgtcctaacctcaggagccccctcccatcctctccccaccctccctatcggggtacttcactgtttcttttctacttgtgtatactcgagaaagggaagatggttaataaaagggatttgtgctgctga

SEQ ID NO: 184009 - DNA, 582 bp, Homo sapiens
  Payload ID: 16256
  Gene Symbol: SLC38A7
  Gene Name: solute carrier family 38, member 7
  ENST ID: ENST00000563196
  CDS Start-End: 299-582
atgtgatgcatgctcacgtgtctccgcagccggctcgggaaagaatcccccaagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggtttt

SEQ ID NO: 184010 - DNA, 1806 bp, Homo sapiens
  Payload ID: 16256
  Gene Symbol: SLC38A7
  Gene Name: solute carrier family 38, member 7
  ENST ID: ENST00000566598
  CDS Start-End: 343-1125
aagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaaggcctttgccattggtcgcaggaacccatctcttagagctatggggccattcttagtccacgatcattccaactggtgggatga

SEQ ID NO: 184011 - DNA, 1437 bp, Homo sapiens
  Payload ID: 16256
  Gene Symbol: SLC38A7
  Gene Name: solute carrier family 38, member 7
  ENST ID: ENST00000564010
  CDS Start-End: 293-1414
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcgggcggtggtggaaggcctgtggctgcgctaccagggggtgccagtggaggaggacgtggggcgggagcggcggcggcgagtgctgcagacgctggtctggttcctgctcaccctgctgctggcgctcttcatccctgacatcggcaaggtgatctcagtcattggaggcctggccgcctgcttcatcttcgtcttcccagggctgtgcctcattcaagccaaactctctgagatggaagaggtcaaaccagccagctggtgggtgctggtcagctacggagtcctcttggtcaccctgggagccttcatcttcggccagaccacagccaacgccatctttgtggatctcttggcataaccactgcctcccagggaacacaa

SEQ ID NO: 184012 - DNA, 564 bp, Homo sapiens
  Payload ID: 16256
  Gene Symbol: SLC38A7
  Gene Name: solute carrier family 38, member 7
  ENST ID: ENST00000562397
  CDS Start-End: 143-564
agccggctcgggaaagaatcccccaaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatgggtatgctggttttcatcatcagtggccttgtcatcctggcctactgctcccaggccagcaatgagaggacctaccaggaggtggtatgggctgtgtgtggcaagctgacaggtgtgctatgtgaggtggccatcgctgtctacacctttgg

SEQ ID NO: 184013 - DNA, 546 bp, Homo sapiens
  Payload ID: 16256
  Gene Symbol: SLC38A7
  Gene Name: solute carrier family 38, member 7
  ENST ID: ENST00000570214
  CDS Start-End: 352-546
atgtgatgcatgctcacgtgtctccgcagccggctcgggaaagaatcccccaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatgggg

SEQ ID NO: 184014 - DNA, 731 bp, Homo sapiens
  Payload ID: 16256
  Gene Symbol: SLC38A7
  Gene Name: solute carrier family 38, member 7
  ENST ID: ENST00000564391
  CDS Start-End: 215-622
aaattgggtccagaaagggaagtgaggagaatcagatcccagacctttggggagaaggagcaaccgcctctggcacagcccatcagggagaaagagcaggttgagaagagtcctaagctaacagccccaaacaggtgggtgttgctcagctccctgaggcatgtggttgtaaggcagaacccacagaccttgcaggaagaaggctctcggggccatggcccaggtcagcatcaacaatgactacagcgagtgggacttgagcacggatgccggggagcgggctcggctgctgcagagtccctgtgtggacacagcccccaagagtgagtgggaagcctctcctgggggtctggacagaggcaccacttccacacttggggccatcttcatcgtcgtcaacgcgtgcctgggtgcagggttactcaacttcccagcagccttcagcactgcggggggcgtggcagcaggcatcgcactgcagatggtgagtgcactggccgggagggcagaggtgcagttcagttgggcgctttgcctcaaaagggaggcttcgggtcagggatggccagtaagtgatacacgcactgctctcccctccctcacacatggcagacatgactaatctattctagtattctttcctgtgacccaaatgaggcttcagaagccttccaacaatcagagaaatttgaacatcaattacatctctaattttttaggtgtaacattga

SEQ ID NO: 184015 - DNA, 760 bp, Homo sapiens
  Payload ID: 16256
  Gene Symbol: SLC38A7
  Gene Name: solute carrier family 38, member 7
  ENST ID: ENST00000565785
  CDS Start-End: 1-511
catcgctgtctacacctttggcacctgcattgccttcctaatcatcattggcgaccagcaggacaagattatagctgtgatggcgaaagagccggagggggccagcggcccttggtacacagaccgcaagttcaccatcagcctcactgccttcctcttcatcctgcccctctccatccccagggagattggtttccagaaatatgccagcttcctgagcgtcgtgggtacctggtacgtcacagccatcgttatcatcaagtacatctggccagataaagagatgaccccagggaacatcctgaccaggccggcttcctggatggctgtgttcaatgccatgcccaccatctgcttcggatttcagtgccacgtcagcagtgtgcccgtcttcaacagcatgcagcagcctgaagtgaagacctggggtggagtggtgacagctgccatggtcatagccctcgctgtctacatggggacagcagagacaaggtctcactatgttgcctagcctggtcttgaattcctgggctcaagcaattctcctgcctcggcctcccaaagtgctggggttacaggcatgagccaccaacccagcctaaaatggggaaggcatctgtggcttcctgacctttggagctgctgtggatcctgacgtgctcctgtcctatccctcggaggacatggccgtggccgttgcccgagccttcatcatcctgagcgtgctcacctcctaccctatcctgcacttctgtgggcg

SEQ ID NO: 184016 - DNA, 1308 bp, Homo sapiens
  Payload ID: 16257
  Gene Symbol: SLC38A8
  Gene Name: solute carrier family 38, member 8
  Uniprot ID: A6NNN8
  ENST ID: ENST00000299709
  CDS Start-End: 1-1308
atggagggacagaccccaggaagcaggggccttccagaaaagcctcaccctgccacggctgctgccactctgtcctcgatgggcgctgtcttcatcctcatgaagtccgcgctgggagctggcctgctcaacttcccctgggccttctccaaagcgggcggagtggtccctgccttcctggtggagctggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctggtcatcctgcccctgtctgccccgcgggagatcgccttccagaaatacacaagcatcctaggcactctggctgcctgttacctggccctggtcatcaccgtgcagtactacctctggccccagggcctcgtgcgtgagtcccatccttcactgagccctgcctcctggacctctgtgttcagtgtcttccccaccatctgcttcgggtttcagtgtcacgaagctgccgtctccatctactgcagcatgcgcaaacggagcctctcccactgggccctggtgtctgtgctgtccttgctggcctgctgcctcatctattcactgacgggggtttatggcttcctgacttttgggacagaagtttctgctgacgtcttgatgtcctacccaggcaatgatatggtcatcattgtggcccgggtcctttttgctgtctccatcgtaactgtctaccccatcgtgctcttcctggggaggtcagtgatgcaggacttctggaggaggagctgcttggggggatgggggcccagcgccctggccgacccctcagggctgtgggtccggatgccgctgaccatcctgtgggtcaccgtgacgctcgccatggcgctgtttatgcctgacctcagcgagatcgtcagcatcatcggaggcatcagttccttcttcatcttcatcttcccaggtttgtgcctcatctgtgcaatgggtgtcgagcctataggaccaagagtcaagtgctgcctggaggtctggggagtggtctctgtgctggtcggcaccttcatctttgggcagagcacggcggcagcggtctgggagatgttctga

SEQ ID NO: 184017 - DNA, 578 bp, Homo sapiens
  Payload ID: 16257
  Gene Symbol: SLC38A8
  Gene Name: solute carrier family 38, member 8
  ENST ID: ENST00000569816
  CDS Start-End: 441-578
acggagtgagactctgtcttaaacacacaaaaacaaagctcgactcctgtgtgcagattgagcctaaaactggtgtgacactcccacactccccacacagagccgggccggccttgcctggtgtcggatgttccgctctcctgcctgccgggtgcaaagccagaattcccttttggggaagcgcggacgccgcgctcttctctttgctgcgggagagccactgatgagcacagctttattttctaagatcctttgccgctggctgatggaatgaattgctgcattttgtggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctg

SEQ ID NO: 184018 - DNA, 861 bp, Homo sapiens
  Payload ID: 16257
  Gene Symbol: SLC38A8
  Gene Name: solute carrier family 38, member 8
  ENST ID: ENST00000568178
  CDS Start-End: 76-861
aaatgcaactgagccacctggagtaagcccgagtcccatccccaacagccaaagactgtccggcaccttaaaaccatggagggacagaccccaggaagcaggggccttccagaaaagcctcaccctgccacggctgctgccactctgtcctcgatgggcgctgtcttcatcctcatgaagtccgcgctgggagctggcctgctcaacttcccctgggccttctccaaagcgggcggagtggtccctgccttcctggtggagctggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctggtcatcctgcccctgtctgccccgcgggagatcgccttccagaaatacacaagcatcctaggcactctggctgcctgttacctggccctggtcatcaccgtgcagtactacctctggccccagggcctcgtgcgtgagtcccatccttcactgagccctgcctcctggacctctgtgttcagtgtcttccccaccatctgcttcgggtttcagtgtcacgaagctgccgtctccatctactgcagcatgcgcaaacggagcctctcccactgggccctggtgtctgtgctgtccttgctggcctgctgc

SEQ ID NO: 184019 - DNA, 2369 bp, Homo sapiens
  Payload ID: 16258
  Gene Symbol: SLC38A9
  Gene Name: solute carrier family 38, member 9
  Uniprot ID: Q8NBW4
  ENST ID: ENST00000318672
  CDS Start-End: 37-1722
aggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtct

SEQ ID NO: 184020 - DNA, 2927 bp, Homo sapiens
  Payload ID: 16258
  Gene Symbol: SLC38A9
  Gene Name: solute carrier family 38, member 9
  Uniprot ID: Q8NBW4
  ENST ID: ENST00000396865
  CDS Start-End: 593-2278
ggtccaaggacgtaaccagatcatacaacacgcgccaggaaagcccaaaagaggggtgatccctcgatggaggtgccgcatcagcgttttctcacgtggcctccggggctctatgaatggcaagagattgcattccttctactacccctcccagcctccagccgggacaaggaactggagcaaactcggggctgcagttccgactggactcgcccacctgggcgcgccggctgcccagcctcctgaagcctcggggctgggccctgcggtgatgggcgtgctggccgtcgcagagccctctgggagttgtagtccgtagcggcgagaggtttgacagcgaccgcgggcttggcgcattcagaactccaactcccgccggcccctgcgacccaggctattgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaa

SEQ ID NO: 184021 - DNA, 2236 bp, Homo sapiens
  Payload ID: 16258
  Gene Symbol: SLC38A9
  Gene Name: solute carrier family 38, member 9
  ENST ID: ENST00000416547
  CDS Start-End: 276-1589
aggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaagattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtct

SEQ ID NO: 184022 - DNA, 2673 bp, Homo sapiens
  Payload ID: 16258
  Gene Symbol: SLC38A9
  Gene Name: solute carrier family 38, member 9
  Uniprot ID: Q8NBW4
  ENST ID: ENST00000515629
  CDS Start-End: 541-2037
aagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtt

SEQ ID NO: 184023 - DNA, 468 bp, Homo sapiens
  Payload ID: 16258
  Gene Symbol: SLC38A9
  Gene Name: solute carrier family 38, member 9
  ENST ID: ENST00000507109
  CDS Start-End: 356-468
gctattgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccagtaggactaagctaatgagagctttgacttgcttaaacgttgggcaggaaagcagaagagaaaagggaagtggaaatcaaaacaacagagaaaagaaaatgcacatatttgggaaatagaacatgttactaacatctgtgtcacataataatcagtggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaag

SEQ ID NO: 184024 - DNA, 571 bp, Homo sapiens
  Payload ID: 16258
  Gene Symbol: SLC38A9
  Gene Name: solute carrier family 38, member 9
  ENST ID: ENST00000513993
  CDS Start-End: 282-571
cccgcggtcgcaaattgcgagaatttgggaagggaatctttatcttctcgtctagttctccgaggttgaaggctcggcctgctcagagaaggaaactgaggtccaccgagttggagaaacctactcaacaccagagtttcctgaataagtttttcccaagttctgtgttattctttttgatgaaaggatactggcttccctacaatcatcttttcaacttctaaaatgtttaattttttaaattgaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgt

SEQ ID NO: 184025 - DNA, 1399 bp, Homo sapiens
  Payload ID: 16258
  Gene Symbol: SLC38A9
  Gene Name: solute carrier family 38, member 9
  ENST ID: ENST00000511233
  CDS Start-End: 35-1399
gactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttagcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaa

SEQ ID NO: 184026 - DNA, 950 bp, Homo sapiens
  Payload ID: 16258
  Gene Symbol: SLC38A9
  Gene Name: solute carrier family 38, member 9
  ENST ID: ENST00000505563
  CDS Start-End: 157-288
aattgcgagaatttgggaagggaatctttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaagacagggtctcactctgtagcccacactggagtgtgatggtgcaatcatggcttgctgcagccttgatctcctgggctgaagcagtcctcccacttcagcctcctgagtagctgggactacaggattggataaataagttgtggcacatttatacaatggaatattttttcctcttaaaaaggaggtggctttattacatatcaaaatggaacaagtcttcaacttattttgttaagtgaaaaattgaagtacagagcagtgtgtatagtatgccaccatttgggtaaaaataaataaatataatatgtataaatgaagttttgggtagtaaataggaaactgtaagatggttgccccctcagagggaaactgagtgctttaggcgggatggtgtggcagatactgttaggtagacacccaacaattaatcagcaaccctacctattccttaatgtcaacagaatccttatttttttgagtcacaatgggtcttcatccaagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattctta

SEQ ID NO: 184027 - DNA, 625 bp, Homo sapiens
  Payload ID: 16258
  Gene Symbol: SLC38A9
  Gene Name: solute carrier family 38, member 9
  ENST ID: ENST00000503817
  CDS Start-End: 320-625
agctatttacaatcatggcataactacctaggcactcagcatctcgatgaaaactgttggaaaagaaaaactttcagagtcattctgccctcagagtagtcaagccaactaaactgtgagaagtcaatgccttgcctttgtgcatcccattactaatggaggataagaagttattttcttcaaaggctgacttccagaatttttggctgaacactttttgtcaagtgtatattccctttgtaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgc

SEQ ID NO: 184028 - DNA, 541 bp, Homo sapiens
  Payload ID: 16258
  Gene Symbol: SLC38A9
  Gene Name: solute carrier family 38, member 9
  ENST ID: ENST00000503891
  CDS Start-End: 149-541
attgccgcttcctgtttggactaggagccccgcggtcgcaaattgcgagaatttgggaagggaatctttatcttctcgtctagttctccgaggttgaaggctcggcctgctcaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatg

SEQ ID NO: 184029 - DNA, 370 bp, Homo sapiens
  Payload ID: 16258
  Gene Symbol: SLC38A9
  Gene Name: solute carrier family 38, member 9
  ENST ID: ENST00000506624
  CDS Start-End: 258-370
aaattgcgagaatttgggaagggaatctttatcttctcgtctagttctccgaggttgaaggctcggcctgctcagagaaggaaactgaggtccaccgagttggagaaacctactcaacaccaggtaaccatttaatggcaaactcgaccaacacctaattgtcatgactcccaggcagtgtcttatccattgccgtgctctgtagatgagcacactataagttgactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaag

SEQ ID NO: 184030 - DNA, 508 bp, Homo sapiens
  Payload ID: 16258
  Gene Symbol: SLC38A9
  Gene Name: solute carrier family 38, member 9
  ENST ID: ENST00000513275
  CDS Start-End: 429-508
gcaaattgcgagaatttgggaagggaatctttatcttctcgtctagttctccgaggttgaaggctcggcctgctcagagaaggaaactgaggtccaccgagttggagaaacctactcaacaccagagtttcctgaataagtttttcccaagttctgtgttattctttttgatgaaaggatactggcttccctacaatcatcttttcaacttctaaaatgtttaattttttaaattgagtaggactaagctaatgagagctttgacttgcttaaacgttgggcaggaaagcagaagagaaaagggaagtggaaatcaaaacaacagagaaaagaaaatgcacatatttgggaaatagaacatgttactaacatctgtgtcacataataatcagtggactaacttcttcagtgcttagagtgtgagaaaaatggcaaatatgaatagtgattctaggcatcttggcacctctgaggtagatcatgaaagagatcctggacctatgaatat

SEQ ID NO: 184031 - DNA, 731 bp, Homo sapiens
  Payload ID: 16258
  Gene Symbol: SLC38A9
  Gene Name: solute carrier family 38, member 9
  ENST ID: ENST00000512208
  CDS Start-End: 170-731
atcttctcgtctagttctccgaggttgaaggctcggcctgctcagagaaggaaactgaggtccaccgagttggagaaacctactcaacaccaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagca

SEQ ID NO: 184032 - DNA, 2370 bp, Homo sapiens
  Payload ID: 16258
  Gene Symbol: SLC38A9
  Gene Name: solute carrier family 38, member 9
  ENST ID: ENST00000508124
  CDS Start-End: 182-313
ttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaagattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtt

SEQ ID NO: 184033 - DNA, 1756 bp, Homo sapiens
  Payload ID: 16258
  Gene Symbol: SLC38A9
  Gene Name: solute carrier family 38, member 9
  Uniprot ID: Q8NBW4
  ENST ID: ENST00000512595
  CDS Start-End: 177-1673
aaatttgtttaactgcgtagattaaatggcaatatattttctataatgaaacttgttgaaatgagagggaatcagctatttacaatcatggcataactacctagggctctgttgtcagcttggtattataatggaaaacaattggatatgtcagagacttagtctattacatttccatggctatttgcattttaacatggagaatccggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgct

SEQ ID NO: 184034 - DNA, 556 bp, Homo sapiens
  Payload ID: 16258
  Gene Symbol: SLC38A9
  Gene Name: solute carrier family 38, member 9
  ENST ID: ENST00000502247
  CDS Start-End: 449-556
attacagtaagttggcaggagttcaaacagttctctgtaaatttgtttaactgcgtagattaaatggcaatatattttctataatgaaacttgttgaaatgagagggaatcagctatttacaatcatggcataactacctaggcactcagcatctcgatgaaaactgttggaaaagaaaaactttcagagtcattctgccctcagagtagtcaagccaactaaactgtatattactggaaacttcagaagaaaatgagggagtttcagaaaggaactgaagaggttgatgactgaaaaggatgattgaacaccaaaatctgcagttgattaggatgcagacgtggaaaggaagcatgtatataaataaaagggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagt

SEQ ID NO: 184035 - DNA, 2324 bp, Homo sapiens
  Payload ID: 16258
  Gene Symbol: SLC38A9
  Gene Name: solute carrier family 38, member 9
  ENST ID: ENST00000505708
  CDS Start-End: 214-1407
agtaagttggcaggagttcaaacagttctctgtaaatttgtttaactgcgtagattaaatggcaatatattttctataatgaaacttgttgaaatgagagggaatcagctatttacaatcatggcataactacctaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcaggctacctggctcgtgtccagcttttgggccatatcttcggtgacatttatcctaggtaagggctcttctcttgaccagcaggatgtgccaagcaacaaatgactgtgcaagcagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaa

SEQ ID NO: 184036 - DNA, 2427 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000310483
  CDS Start-End: 467-1441
aggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctaga

SEQ ID NO: 184037 - DNA, 2084 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000356205
  CDS Start-End: 111-1085
gggagctatgggagggggcgggaattcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagta

SEQ ID NO: 184038 - DNA, 2398 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000368621
  CDS Start-End: 437-1411
gtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagac

SEQ ID NO: 184039 - DNA, 2723 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000368623
  CDS Start-End: 761-1735
cagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtgatgagatatccatacagcctttctcatgcctcggtttcccccgtgcagtctccctgaataagtcacttgggaaagaaagtgtgagaagagaggaatgttcctggtacaggagtagatgagtcaccctgggtaggggaaggtcacaaagtggctggggccagggagctgcactctgctgaccaagcttccccattccttgccccatcttcctttgcatgatttttcccaaccactctggtctgtcttcctaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaca

SEQ ID NO: 184040 - DNA, 1030 bp, Homo sapiens
  Payload ID: 16259
  Gene Symbol: SLC39A1
  Gene Name: solute carrier family 39 (zinc transporter), member 1
  ENST ID: ENST00000413622
  CDS Start-End: 311-1030
ggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggct

SEQ ID NO: 184041 - DNA, 1141 bp, Homo sapiens
  Payload ID: 16259
  Gene Symbol: SLC39A1
  Gene Name: solute carrier family 39 (zinc transporter), member 1
  ENST ID: ENST00000429040
  CDS Start-End: 179-1141
agtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttc

SEQ ID NO: 184042 - DNA, 912 bp, Homo sapiens
  Payload ID: 16259
  Gene Symbol: SLC39A1
  Gene Name: solute carrier family 39 (zinc transporter), member 1
  ENST ID: ENST00000417348
  CDS Start-End: 294-912
ccatcctggggcctgaagcgcttgttctctgcgctgggaaaaggggaacgatggagcgatccagcacccaaacttaccctgtccaggtggcccacgaagctacccaagacatctctgcacagccctagcctttttggcttcacccactccgttcgggagttggggacccggcctctacattccttaggggaactccagctccaggtcctatttggaggcggctcctagtttcctagttttctgggggcaccaggtgaaagggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcggg

SEQ ID NO: 184043 - DNA, 2022 bp, Homo sapiens
  Payload ID: 16259
  Gene Symbol: SLC39A1
  Gene Name: solute carrier family 39 (zinc transporter), member 1
  ENST ID: ENST00000537590
  CDS Start-End: 180-530
gtctgtccccgcccactcggtgctgccattggcagtcggtcgtgggtacgcggctcctgtgggggaggggggagctatgggagggggcgggaattcccgactctaggccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagta

SEQ ID NO: 184044 - DNA, 2214 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000617697
  CDS Start-End: 241-1215
actacaaaagtggatgccaccttgccaggagccacggtagggccgctgtatctgggagtaggggactaagagtctgagggtccacaaacggaatttaagaagtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagta

SEQ ID NO: 184045 - DNA, 2322 bp, Homo sapiens
  Payload ID: 16259
  Gene Symbol: SLC39A1
  Gene Name: solute carrier family 39 (zinc transporter), member 1
  Uniprot ID: Q9NY26
  ENST ID: ENST00000621013
  CDS Start-End: 349-1323
gagtgcgggctgtctggcagcggggtccatgtcggctgcccaggcctccccgggcccgggaacaggagtcccagctcacgcattcttcatctgcttcccgcgacgcttggcggcctcgcaccccgcctcctggagcccggactttcaggcaccgccctcagtgtcgcctcagtccgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagta

SEQ ID NO: 184046 - DNA, 5322 bp, Homo sapiens
  Payload ID: 16260
  Gene Symbol: SLC39A10
  Gene Name: solute carrier family 39 (zinc transporter), member 10
  Uniprot ID: Q9ULF5
  ENST ID: ENST00000359634
  CDS Start-End: 166-2661
gagtggaccttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaata

SEQ ID NO: 184047 - DNA, 5432 bp, Homo sapiens
  Payload ID: 16260
  Gene Symbol: SLC39A10
  Gene Name: solute carrier family 39 (zinc transporter), member 10
  Uniprot ID: Q9ULF5
  ENST ID: ENST00000409086
  CDS Start-End: 276-2771
agttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaata

SEQ ID NO: 184048 - DNA, 593 bp, Homo sapiens
  Payload ID: 16260
  Gene Symbol: SLC39A10
  Gene Name: solute carrier family 39 (zinc transporter), member 10
  ENST ID: ENST00000458054
  CDS Start-End: 216-593
attagatggggggctgcggcttggagaacactcacagttctgagttcagctgtggacggaataatgaagggcagctgcagaaggaggtagagctgcagattcagagcccctggacctgagaggcttcaataattgttacctgagttggattgaattgaaataaagaagtaaagatcctatatcatctactgaaatctttaaagggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacat

SEQ ID NO: 184049 - DNA, 544 bp, Homo sapiens
  Payload ID: 16260
  Gene Symbol: SLC39A10
  Gene Name: solute carrier family 39 (zinc transporter), member 10
  ENST ID: ENST00000444421
  CDS Start-End: 112-231
gcggcgttctttcttggaacaaaactagcgcggagccacggaactccgcagtttgcgtagacttgaatttcctattcctcggacgatccatgtggaatccgaaaaatagaaatgaagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgat

SEQ ID NO: 184050 - DNA, 4478 bp, Homo sapiens
  Payload ID: 16260
  Gene Symbol: SLC39A10
  Gene Name: solute carrier family 39 (zinc transporter), member 10
  ENST ID: ENST00000430412
  CDS Start-End: 166-285
gagtggaccttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgaggaaaaatagaaatgaagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaata

SEQ ID NO: 184051 - DNA, 337 bp, Homo sapiens
  Payload ID: 16260
  Gene Symbol: SLC39A10
  Gene Name: solute carrier family 39 (zinc transporter), member 10
  ENST ID: ENST00000412905
  CDS Start-End: 222-337
cttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgagagatcctctttgtgctgtcgatggaaaagattgttaacatctactggaatgcttgggaaactctgaaaaatagaaatgaaggtacatatgcacacaaaattttgcctcatttgtttgctgacatttatttttcatcattgcaaccattgccatgaagaacatgaccatggccctgaagcgcttcacagaca

SEQ ID NO: 184052 - DNA, 563 bp, Homo sapiens
  Payload ID: 16260
  Gene Symbol: SLC39A10
  Gene Name: solute carrier family 39 (zinc transporter), member 10
  ENST ID: ENST00000418005
  CDS Start-End: 173-563
gcagtcggcggcggccagccgaagcagagcgcgtggtgggcagagtgttgggcgccgcggctcctcgtgtgcggtctgggctgctgcgggccgcgggatcgggagccggcggcatccacttcgcgtgcggagcctcgcgcccccctcaccttcctgtggaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcatt

SEQ ID NO: 184053 - DNA, 2808 bp, Homo sapiens
  Payload ID: 16261
  Gene Symbol: SLC39A12
  Gene Name: solute carrier family 39 (zinc transporter), member 12
  Uniprot ID: Q504Y0
  ENST ID: ENST00000377369
  CDS Start-End: 274-2349
ttgttaccttcagagcagctctctccatagcaactgaaaacttttctgggctgaaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaatatggtg

SEQ ID NO: 184054 - DNA, 2725 bp, Homo sapiens
  Payload ID: 16261
  Gene Symbol: SLC39A12
  Gene Name: solute carrier family 39 (zinc transporter), member 12
  Uniprot ID: Q504Y0
  ENST ID: ENST00000377371
  CDS Start-End: 199-2271
gtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 184055 - DNA, 2639 bp, Homo sapiens
  Payload ID: 16261
  Gene Symbol: SLC39A12
  Gene Name: solute carrier family 39 (zinc transporter), member 12
  Uniprot ID: Q504Y0
  ENST ID: ENST00000377374
  CDS Start-End: 221-2185
aaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 184056 - DNA, 2461 bp, Homo sapiens
  Payload ID: 16261
  Gene Symbol: SLC39A12
  Gene Name: solute carrier family 39 (zinc transporter), member 12
  Uniprot ID: Q504Y0
  ENST ID: ENST00000539911
  CDS Start-End: 329-2002
ttgttaccttcagagcagctctctccatagcaactgaaaacttttctgggctgaaataatcctctctagctcccagtgcacagtcaaagaattttaaaaacagggaactttgtaactgtgaaatactctccaggatttaaaaggctgtggagctccagataaagaatcgtttatctttcttctgaagtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaatatggtg

SEQ ID NO: 184057 - DNA, 2289 bp, Homo sapiens
  Payload ID: 16262
  Gene Symbol: SLC39A13
  Gene Name: solute carrier family 39 (zinc transporter), member 13
  Uniprot ID: Q96H72
  ENST ID: ENST00000354884
  CDS Start-End: 62-1156
gccgcccggatcgccgccgccgccgccgcacggtggccttttgtgtttttcagtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcccggagtaagcagcgaggaagagcagcactggtcccaagcagaggccttgccctgctgggaccccgggagtgagagcagcccaaggatccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacata

SEQ ID NO: 184058 - DNA, 2296 bp, Homo sapiens
  Payload ID: 16262
  Gene Symbol: SLC39A13
  Gene Name: solute carrier family 39 (zinc transporter), member 13
  Uniprot ID: Q96H72
  ENST ID: ENST00000362021
  CDS Start-End: 43-1158
gggccgcccggatcgccgccgccgccgccgcacgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggagtagttgggtgttctcccgctgcagaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcccggagtaagcagcgaggaagagcagcactggtcccaagcagaggccttgccctgctgggaccccgggagtgagagcagcccaaggatccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacatactggc

SEQ ID NO: 184059 - DNA, 785 bp, Homo sapiens
  Payload ID: 16262
  Gene Symbol: SLC39A13
  Gene Name: solute carrier family 39 (zinc transporter), member 13
  ENST ID: ENST00000531419
  CDS Start-End: 67-720
cgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggtcagcggctacctcaacctgctggccaacaccatcgataacttcacccacgggctggctgtggctgccagcttccttgtgagcaagaaggtgaggggcttggggccagtggggctctggcgattccagtggcagccatgtggattccacctgtgtctggagtctctgcttcttgcccctcc

SEQ ID NO: 184060 - DNA, 827 bp, Homo sapiens
  Payload ID: 16262
  Gene Symbol: SLC39A13
  Gene Name: solute carrier family 39 (zinc transporter), member 13
  ENST ID: ENST00000526614
  CDS Start-End: 82-827
ggggacattggtctcatgtcctaggaagaagcgtggatggtcttgccctggctcatctgctcagtttccccactacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaaggtgaggggctt

SEQ ID NO: 184061 - DNA, 1805 bp, Homo sapiens
  Payload ID: 16262
  Gene Symbol: SLC39A13
  Gene Name: solute carrier family 39 (zinc transporter), member 13
  ENST ID: ENST00000533076
  CDS Start-End: 411-1388
ataagatggagcgcttttgcatacagggaggggggcattttagaagtcctagggcaggatccctgagtagcttttctttgccaagaaactaacccagggattccattttggaactcagggagggaacagaacgtcctggcagttgtatgggcccggtggggtgagatggacagaaagcttcagaagacaagctgggccaccagggagaagttggcggtctaaggaaggccaacagtgcaacatgaagtgggacaggcaccagaggcagccctgagagctgagtgtgctctcaagagccccagcagaggggaaagtgacagagtaaatggttggagctgccatgggaggctgatgagggtcagagacttaagagacctgtactcagtcgctatctctgcccaatacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaagggaaggagacggcagcctgggtcctgcccttcacctctggcggctttctctacatcgccttggtgaacgtgctccctgacctcttggaagaagaggacccgtggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccacat

SEQ ID NO: 184062 - DNA, 846 bp, Homo sapiens
  Payload ID: 16262
  Gene Symbol: SLC39A13
  Gene Name: solute carrier family 39 (zinc transporter), member 13
  ENST ID: ENST00000531865
  CDS Start-End: 44-819
ggggccgcccggatcgccgccgccgccgccgcacgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggtcagcggctacctcaacctgctggccaacaccatcgataacttcacccacgggctggctgtggctgccagcttccttgtgagcaagaagatcgggctcctgacaaccatggccatcctcctgcatgagatcccccatgaggtgggcgactttgccatcctgctccgggccggctttgaccgatggagcgcagccaagctgcaactctcaacagcgctggggggcctactgggcgctggcttcgccatctgtacccagtcccccaa

SEQ ID NO: 184063 - DNA, 568 bp, Homo sapiens
  Payload ID: 16262
  Gene Symbol: SLC39A13
  Gene Name: solute carrier family 39 (zinc transporter), member 13
  ENST ID: ENST00000527091
  CDS Start-End: 154-568
attagggaaagtttagcctcaggcggaggtgctgacacagtctggagctgctcagaaggaaaaaatacgcagtgctcaggagtagggtgtggagacacagggccccattgctgtgcacccagcatttggatgctcagacgctctgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctg

SEQ ID NO: 184064 - DNA, 856 bp, Homo sapiens
  Payload ID: 16262
  Gene Symbol: SLC39A13
  Gene Name: solute carrier family 39 (zinc transporter), member 13
  ENST ID: ENST00000531974
  CDS Start-End: 88-510
cggggcagagcctgggcggggcgcggcaccgcagctggatggctggggccgcccggatcgccgccgccgccgccgcacgtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtaagtgaggccacacgccaggggcaagacagtgccaggagtgggggcctggtgcccacgcccagggatggccaggatgaccaggagagggattctgggtttctggcaggagcttgcctgggagggagggagggtcattgtcctggtctctgggccctggtcccagtgggagttctgggccccagctgcccaacccacccttgtcactgccctggtgccctggatgagatcccattccaaatggccccctcctatggccctggcttggcttggcctggcctggcctggcattgccgccccctgcaggtggtgaggggcagagcctgcagcagcagcaacagctggggctgtggg

SEQ ID NO: 184065 - DNA, 3553 bp, Homo sapiens
  Payload ID: 16262
  Gene Symbol: SLC39A13
  Gene Name: solute carrier family 39 (zinc transporter), member 13
  ENST ID: ENST00000524928
  CDS Start-End: 11-976
agtacgtggcatgcctggatgtccctgccctggctgtggcatggcgggcccaaggctcctcttcctcactgcccttgccctggagctcttggaaagggctgggggttcccagccggccctccggagccgggggactgcgacggcctgtcgcctggacaacaaggaaagcgagtcctggggggctctgctgagcggagagcggctggacacctggatctgctccctcctgggttccctcatggtggggctcagtggggtcttcccgttgcttgtcattcccctagagatggggaccatgctgcgctcagaagctggggcctggcgcctgaagcagctgctcagcttcgccctggggggactcttgggcaatgtgtttctgcatctgctgcccgaagcctgggcctacacgtgcagcgccagccctggtggtgaggggcagagcctgcagcagcagcaacagctggggctgtgggtcattgctggcatcctgaccttcctggcgttggagaagatgttcctggacagcaaggaggaggggaccagccaggcccccaacaaagaccccactgctgctgccgccgcgctcaatggaggccactgtctggcccagccggctgcagagcccggcctcggtgccgtggtccggagcatcaaagtcagcggctacctcaacctgctggccaacaccatcgataacttcacccacgggctggctgtggctgccagcttccttgtgagcaagaaggtgaggggcttggggccagtggggctctggcgattccagtggcagccatgtggattccacctgtgtctggagtctctgcttcttgcccctccattgccagcgccctcatctaaggctctcatcccccatcctccctgctgctgtcctggccgccactgttctctgatcctgagcccctggtctgttcctgttcccagtactccttgttgggtgcctctgtcaagctgctaggcgtggcccctgcctgctcctagatgcttcttcctctacctcctccctctggcctctggcctctggcccagaggcagcctactctgcagctggccgagatctttcccacctcacactgttccccctgcctggaatgttctcccgcccacgcttcgagcggctgacgactcatccttggggcctcgacttacatggactcctccaccaggcctttgctgacctcctcatctaaatttggttcctgggcctgctcccctgggcactctatccatcctttccttcccagcgcctgtgagtgtgtgagtgagtcctgtctctcccctctataccgctagcttcgtgaaggcaggttccttgtcccctttagtcactgctgtatttccagtggccaacacagtgcccacccagagccagctcagagcagagtaaacctctgtggaatgagtgggcgagtggggtgctcagccctcaacacagaccccgcagccacggctcccctccctgcagatcgggctcctgacaaccatggccatcctcctgcatgagatcccccatgaggtgagcgcttgtagggcagcccccaggggcccaggcccccacagtgcccatgatcagcatgggtgtggagctcaggagggtgtggggctgggcctgtccagcatggcactctggggctgggctgtgagggctggagctcctcaccccagcagcctgcagctgccatctctgccatactcaggatgggggtcccaggggaagggtggggaagggcagggggctcagtgtgtatatcgtacctgagcactcagggcatcaggccccgctggggcgcagggtgaacctctggacctcccttcaggtgggcgactttgccatcctgctccgggccggctttgaccgatggagcgcagccaagctgcaactctcaacagcgctggggggcctactgggcgctggcttcgccatctgtacccagtcccccaagggagtaggtacgggcgtggcgggtggttgtggcgggtggcatcagcagaggggcaccagccaaagggtgtggctaccgcactgctggtccccaggcccgggaggtggggagcacacacagtgccttgggtacccagttgggtgttctcccgctgcagaggagacggcagcctgggtcctgcccttcacctctggcggctttctctacatcgccttggtgaacgtgctccctgacctcttggaagaagaggacccgtggtgagtgacctgttggaggaagaggactgccactcacagggcccttaggggctcaggagggaagggctcctggccgctgcctgctccccctgcccatgcctccaccgtgagccgttccctccccacaggcgctccctgcagcagctgcttctgctctgtgcgggcatcgtggtaatggtgctgttctcgctcttcgtggattaactttccctgatgccgacgcccctgccccctgcagcaataagatgctcggattcactctgtgaccgcatatgtgagaggcagagagggcgagtggctgcgagagagaatgagcctcccgccagacaggagggaggtgcgtgtggatgtatgtggtgtgcacatgtggccagaggtgtgtgcgcgagaccgacactgtgatccctgtgctgggtccggggcccagtgtagcgcctgtccccagccatgctgtggttacctctccttgccgccctgtcaccttcacctcccggagtaagcagcgaggaagagcagcactggtcccaagcagaggccttgccctgctgggaccccgggagtgagagcagcccaaggatccagggtgcagggaactccagagctgcccacctcccactgccccctcagcacacacacagtccccaggcggcctaggggccaaggctggggcggctttggtcccttttcctggcccttccttccccacttctaagccaaagaaaggagaggcaggtgctcctgtaccccagccccactcagcactgacagtccccagctcctagtagtgagctgggaggcgcttcctaagaccctttcctcagggctgccctgggagctcattcctggccaacacgccctggcagcaccagcagctcttgccacctccagctgccaaacagcagcctgccgggcagggagcagccccaggccagagaggcctcccggtccagctcagggatgctcctgccagcacaggggccagggactcctggagcaggcacatagtgagcccgggcagccctgcccagctcaggcccctttccttccccattgaggttggggtaggtgggggcggtgagggctccacgttgtcagcgctcaggaatgtgctccggcagagtgctgaagccataatccccaaccatttcccttggctgacgcccaggtactcagctggcccactccacagccaggcctggccctgcccttcaccgtggatgttttcagaagtggccatcgagaggtctggatggttttatagcaactttgctgtgattccgtttgtatctgtaaatatttgttctatagataagatacaaataaatattatccaca

SEQ ID NO: 184066 - DNA, 1708 bp, Homo sapiens
  Payload ID: 16263
  Gene Symbol: SLC39A14
  Gene Name: solute carrier family 39 (zinc transporter), member 14
  Uniprot ID: Q15043
  ENST ID: ENST00000240095
  CDS Start-End: 138-1583
cagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaactgagccagccatgtttgttaataaaaatggggacaatactgtatatatatggttatattttagctttttcacttttcagtatctcctgaggcttttctcatgtcattaaatatttttctaatttaaaa

SEQ ID NO: 184067 - DNA, 2137 bp, Homo sapiens
  Payload ID: 16263
  Gene Symbol: SLC39A14
  Gene Name: solute carrier family 39 (zinc transporter), member 14
  Uniprot ID: Q15043
  ENST ID: ENST00000289952
  CDS Start-End: 217-1695
cacacgcccggacggctgggtggaggctgcacctggccgtggtgccgcgctggcgaggggagaggtcaaggcgcggcctgtccgcctggagggtgcgggatgctagagccgcagaagggtgcccagagcgtgggtcgccgcgccgaaggctgagccaggctcccggattccccgcgcggacacggacgcagaacgcagacagtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttg

SEQ ID NO: 184068 - DNA, 4641 bp, Homo sapiens
  Payload ID: 16263
  Gene Symbol: SLC39A14
  Gene Name: solute carrier family 39 (zinc transporter), member 14
  Uniprot ID: Q15043
  ENST ID: ENST00000359741
  CDS Start-End: 176-1654
atatagccgggcatgcgcgcggtgccggggcccggacgcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaa

SEQ ID NO: 184069 - DNA, 4641 bp, Homo sapiens
  Payload ID: 16263
  Gene Symbol: SLC39A14
  Gene Name: solute carrier family 39 (zinc transporter), member 14
  Uniprot ID: Q15043
  ENST ID: ENST00000381237
  CDS Start-End: 120-1598
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaatcccacgggtgatcatttgcaataaatgtggatgtaatgaaggctgttgaacacaa

SEQ ID NO: 184070 - DNA, 839 bp, Homo sapiens
  Payload ID: 16263
  Gene Symbol: SLC39A14
  Gene Name: solute carrier family 39 (zinc transporter), member 14
  ENST ID: ENST00000517370
  CDS Start-End: 235-839
tctgatttttcttttttgttccgttaatatccaccaaacttttccttgcgacctccctatctgctccaccttcctcccgctaaatggtggttgctgtgcaatggggcatgtgccttctctccctgccctgggtggggctggccctccctccgcacggcagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttccc

SEQ ID NO: 184071 - DNA, 377 bp, Homo sapiens
  Payload ID: 16263
  Gene Symbol: SLC39A14
  Gene Name: solute carrier family 39 (zinc transporter), member 14
  ENST ID: ENST00000520644
  CDS Start-End: 108-377
gcccggacgcagtgaggggggtcggcgcgcgtgtctacgcggacgcaccggctaagctgcttctgccgccgccggccgcctgggaccttgcggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacg

SEQ ID NO: 184072 - DNA, 578 bp, Homo sapiens
  Payload ID: 16263
  Gene Symbol: SLC39A14
  Gene Name: solute carrier family 39 (zinc transporter), member 14
  ENST ID: ENST00000520832
  CDS Start-End: 419-578
acactcactccgcgctcagcgtggggctaaataagccattccctgtttgtctgtgccgctgcctggggccctgaccacccgtctctgcctcataacctcctcccacaggcgctggcacacacagtgggggctcagtaaatattagttggtgaacagcaggctcaaggttctaattttgttccctgcttctgggtcaccagagtttttattattatttttcttagttttcccatcctgcccctcccatcagcgcgaggtttcacaaggagagtgagtgggctccgctggccgccctcctgcactgtctggaaatttcccaccctgggtgcgctttgactgtgccaaggcttgaggcgaaggtcctgggagcaggagctggaggaagataatgcatcctttcagggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagg

SEQ ID NO: 184073 - DNA, 560 bp, Homo sapiens
  Payload ID: 16263
  Gene Symbol: SLC39A14
  Gene Name: solute carrier family 39 (zinc transporter), member 14
  ENST ID: ENST00000522881
  CDS Start-End: 95-560
gaacatcacagaagcgtctgtgcaggacagaagtgccgcttctaggcagagctacttctggaccaagtgaagggtgacggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggct

SEQ ID NO: 184074 - DNA, 570 bp, Homo sapiens
  Payload ID: 16263
  Gene Symbol: SLC39A14
  Gene Name: solute carrier family 39 (zinc transporter), member 14
  ENST ID: ENST00000524285
  CDS Start-End: 304-570
acacgcccggacggctgggtggaggctgcacctggccgtggtgccgcgctggcgaggggagaggtcaaggcgcggcctgtccgcctggagggtgcgggatgctagagccgcagaagggtgcccagagcgtgggtcgccgcgccgaaggctgagccaggctcccggattccccgcgcggacacggacgcagaacgcagacagagagaaggcaagcttggctgctgtggaggctggggcccatcctcagaccatctgctcccctcatggtgacacagatctgaaaaccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctcc

SEQ ID NO: 184075 - DNA, 576 bp, Homo sapiens
  Payload ID: 16263
  Gene Symbol: SLC39A14
  Gene Name: solute carrier family 39 (zinc transporter), member 14
  ENST ID: ENST00000517552
  CDS Start-End: 195-576
attcgtttttattctgtgctttcaaaagaagggtttttctcaaaggctaattcaagaaggagcagagaagcagagactgagggatagtctcaacatgttcagtgtgtggcgggcgggcctggcgcagttgccggcacacagggagaggcctcagcttcacctgcctttttctctcacaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattccc

SEQ ID NO: 184076 - DNA, 467 bp, Homo sapiens
  Payload ID: 16263
  Gene Symbol: SLC39A14
  Gene Name: solute carrier family 39 (zinc transporter), member 14
  ENST ID: ENST00000519960
  CDS Start-End: 100-467
aagtaaaatgcttaataaaaccccggtttagactgtcttcaaaccgaccgccaccccagagcctgcagctgactctgaccccgcgtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctcca

SEQ ID NO: 184077 - DNA, 1379 bp, Homo sapiens
  Payload ID: 16264
  Gene Symbol: SLC39A2
  Gene Name: solute carrier family 39 (zinc transporter), member 2
  Uniprot ID: Q9NP94
  ENST ID: ENST00000298681
  CDS Start-End: 158-1087
tgcagaagcagaagcaacacagaaagaagataccaacagcctcctgaaactcacgagagtggacactccagtgttgaccacctaagataccactcctgctccaaagattacagctcccttgtcattctgactcctgggcttaccctacaccccagagatggagcaactactaggaataaaacttggctgcctgtttgccctgttggctctcactctgggctgtggccttactcccatctgcttcaaatggttccagattgatgcagccagaggtcatcaccggctagtcctcagactcctgggctgtatttctgctggtgttttcctgggagcagggttcatgcatatgactgctgaagccctggaggaaattgaatcacagattcagaagttcatggtgcagaacagatcagcaagtgagagaaattcttctggtgatgctgattcagctcatatggagtatccctatggagagctcatcatctccctgggcttcttttttgtcttctttttggagtcgctggcattgcagtgctgtcctggggctgctggaggatcgacagtgcaggacgaagaatggggtggggctcatatcttcgaactccacagccatggacatttaccctcaccctcaaagggtcccctccgagcccttgtcctcttgctgtcactctcctttcactcagtgtttgaagggctagctgtggggctgcagccgacagtagcagctaccgtgcagctctgccttgctgtcctggctcataaggggcttgtggtgtttggtgtaggaatgcggctagtgcatttaggtaccagctcacgatgggcagtgttctccatactattattagctctcatgtcccccctgggcctagccgtagggctggctgtgactggaggggactctgaaggagggcggggcttagcccaggctgtgttagagggtgtggcagctggtaccttcctgtatgtcaccttcctagaaattcttccacgggagctagctagtcctgaggcccctctagctaagtggagctgtgtagccgctggttttgccttcatggcctttattgccttgtgggcctgagagattcctggcttttctgatggacctatttaggacaacctctctatccccagggagacctcccaaatggctttgaccctcagacatttctttactcagactaaatagcattcagtaggactggactggaccccaggtttcctttacatgagatcccatttctcaccctggactaagacaaagatatttaggttgagcagctattaattggagaattggtacagagacgctccagattttattcttatcccatttatgctactgtgtgtaataaaatgcccattttaccctc

SEQ ID NO: 184078 - DNA, 1259 bp, Homo sapiens
  Payload ID: 16264
  Gene Symbol: SLC39A2
  Gene Name: solute carrier family 39 (zinc transporter), member 2
  Uniprot ID: Q9NP94
  ENST ID: ENST00000554422
  CDS Start-End: 193-450
agaagctggggcaggatctgtcagctctgcaatgctgcagaagcagaagcaacacagaaagaagataccaacagcctcctgaaactcacgagagtggacactccagtgttgaccacctaagataccactcctgctccaaagattacagctcccttgtcattctgactcctgggcttaccctacaccccagagatggagcaactactaggaataaaacttggctgcctgtttgccctgttggctctcactctgggctgtggccttactcccatctgcttcaaatggttccagattgatgcagccagaggtcatcaccggctagtcctcagactcctgggctgtatttctgctggtgttttcctgggagcagggttcatgcatatgactgctgaagccctggaggaaattgaatcacagattcagaagttcatggtgcagatcagcaagtgagagaaattcttctggtgatgctgattcagctcatatggagtatccctatggagagctcatcatctccctgggcttcttttttgtcttctttttggagtcgctggcattgcagtgctgtcctggggctgctggaggatcgacagtgcaggacgaagaatggggtggggctcatatcttcgaactccacagccatggacatttaccctcaccctcaaagggtcccctccgagcccttgtcctcttgctgtcactctcctttcactcagtgtttgaagggctagctgtggggctgcagccgacagtagcagctaccgtgcagctctgccttgctgtcctggctcataaggggcttgtggtgtttggtgtaggaatgcggctagtgcatttaggtaccagctcacgatgggcagtgttctccatactattattagctctcatgtcccccctgggcctagccgtagggctggctgtgactggaggggactctgaaggagggcggggcttagcccaggctgtgttagagggtgtggcagctggtaccttcctgtatgtcaccttcctagaaattcttccacgggagctagctagtcctgaggcccctctagctaagtggagctgtgtagccgctggttttgccttcatggcctttattgccttgtgggcctgagagattcctggcttttctgatggacctatttaggacaacctctctatccccagggagacctcccaaatggctttgaccctcagacatttctttactcagactaaatagcattcagtaggactggactggaccccaggtttcc

SEQ ID NO: 184079 - DNA, 1502 bp, Homo sapiens
  Payload ID: 16265
  Gene Symbol: SLC39A3
  Gene Name: solute carrier family 39 (zinc transporter), member 3
  Uniprot ID: Q9BRY0
  ENST ID: ENST00000269740
  CDS Start-End: 331-1275
tggagtcgcatatgagtggcaggtttcgcagccaatagtatggaaagttctgccagcgggtctcggggaggccaatgggcaggggcgtgggcggggcgtggaccagccgcgccgagcggggcctctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggtgagcggcctcgccattgtccctgccgccggagcccgccgggagccccgggccggacacaggccgcgtcccccggccgcgcgtcccccaagagcgagcactgtggccctgggccaccacctgtgcacaaggggcctcccgggaccaggctgtgcccccgatcctacaccctgagcctcagagcactgctactttttaaaatacttctttctcttaaaagtctttaccaaa

SEQ ID NO: 184080 - DNA, 2940 bp, Homo sapiens
  Payload ID: 16265
  Gene Symbol: SLC39A3
  Gene Name: solute carrier family 39 (zinc transporter), member 3
  Uniprot ID: Q9BRY0
  ENST ID: ENST00000455372
  CDS Start-End: 207-524
ctccgggccgcgtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaaggtaagggctccctgggcactagcagcagcccttggcaccttatggccaagggactctgatgcattttcaacactgatgccaagttcagtgaaggccttgatgctgtaagggtgacggaaagtaggaagtgaatttgctgtgtgattgtgaactggttactttctgtctctgtgctctaccggccaaacaaggggtttggaccagacctgggattcccaacaggtggacttgtcggttgtcacctgataatcagaccagactacccacctaggtagggcacactctgtcctgaagctggaaagcatggcctctcttcggttcctatatcagtcagctactgttgcgtaacaaattatagcaaactgagcaccttaggactacagacgtttatcatctcacagtttctgtgagtcaggggtctgggcactgcttcaggagctcacaaggcagcagtcacagtgtctcctgggctgtggtctcatctcaacgttcaaccggggatgggtcggcctctaagctcatgtggttgtaagccaggttcagttcctcattggttgtcagaccgaaggtgtctgtttgtcagtgtctgttggctggggcagccctcagagcctggccacgtggacctccccagcatgatcagttccttcatcagcaaatggagaagatggccatgactctgtgtaagacagagggcacagtcccatgtcatgcagaggtgacagggtatcccttcccctctgccccagtgtcctgctggttagaagcaagttcaagtccttcccatactcaagtggccaggacctcacagggtatggctgtcaagaggcaggggcttctggggccatcttggagtctgtccaccccaactcctgacagcatcatcctctgctgacctgttccttgagctcccccatatcagcagcccagagtgtgggtcccctgtcaggccacagtgtgaccagccctggccatgcttgctgggtgaccctgggtgagtggcttcctctctctgggccagtgccagatgtgacattgaatttgtgttggttacatacttggtggagatatgaggaccccctgttcttcctcccaacgaaagcatggaagccctaagcttatcccccaacccctggccctgcttttcctcgtgcctagtgtccagaaaggaggagaagggctgttgtctgggattaaatcatctgagcctgttagtgtggcagagtagagttccagggtggctccctgagcttccagcccctgctccgcacgccccatgctcttccctcccctcgagtgtgggtagggctgggactgccgtgcgtgtcactcctgccattatgtcagaatcccagcagaggggatgttgcagctgtgatgaccgccccagatcggttagcgctgagttcatcaaaagggagggggtgggcctggcctaatcaggtgagccactcaccctcctgctggccttggagaagcaaaaagccagggtgtgccaggagaagggcatgaagcgaggacccgagggcagcctctcggtgccaagagccatccccgccaacagccagccaggacacggggcctcagtccacagccaccaggaggtggactcttccgacctccagtgagcttggaagaggaccctgggtgtcagtgagatctcagccctgatgacaccctgcgagacctggagcgtagggcccagctagcccgcacctggatttccaccgttcagagccgagacaccgcattcctgctgttccgcgtggctgagtctgcattcgttcgttacgcggtgtgtgaagactgacatctgcactgcgaggatggagatcttggtcatctctgacatctcctgcatcgcagaggccactgccagccccccttttcccccatggtcatggtgtcacccccgtcaccctctgactgcaggcctgggcgactgcggggagcttgctcttccctccccctcatcacagtggccttctcatggcacccaaacctttcccgccgttctcctgtcctcgggctggtcaggcggatgaggtccctactcccgagcccccagcctcacccactgcagggccaggctctcagtcacccctggaaaatggtgcctggttcacagctcccgtgcatctgcctcatctctcctgatcaacgtctgtctcttgggagtagctagagttcctcatgagcttgtcctcaagcgaggcatgcatgaggcctccagccggtggtcagtgagggagttaagtggcttctccgtggaaacacagccttctgctgcagcagaggctcacccagcgtgaactgcccccagggaacactgggcgatgcctggggacattgtggttgtcacgatggggggtgctcctggcctggagtgggtggaggccagagacactgctcagcagcaccctgcagtgcccaggacggccccgtcccagagaacaatccagccccgaatgtcagcaccttccccctacccgagttgtgaaaataaaaaatgtttccagacatt

SEQ ID NO: 184081 - DNA, 1219 bp, Homo sapiens
  Payload ID: 16265
  Gene Symbol: SLC39A3
  Gene Name: solute carrier family 39 (zinc transporter), member 3
  ENST ID: ENST00000545664
  CDS Start-End: 196-1167
gtctgtggggtcgagactgcgcggccgttgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagccccttcatggggggcgcgcggggccacgcgctgtacgtggagccccacggccacggccccagcctgagcgtgcagggcctctcgcgcgccagccccgtgcgcctgctcagcctggccttcgcgctgtcggcccactcggtctttgagggcctggccctgggcctgcaggaggagggggagaaagtggtgagcctgttcgtgggggtggccgtccacgagacactggtggccgtggccctgggcatcagcatggcccggagtgccatgcccctgcgggacgcggccaagctggcggtcaccgtaagcgccatgatccccctgggcatcggcctgggcctgggcattgagagcgcccagggcgtgccgggcagcgtggcgtccgtgctgctgcagggcctggcgggcggcaccttcctcttcatcaccttcctggagatcctggccaaggagctggaggagaagagtgaccgtctgctcaaggtcctcttcctggtgctgggctacaccgtcctggccgggatggtcttcctcaagtggatctcgccgcccgagccccgagtgtcttgaggcttattagaggttggagtcactgcgatgggacagccgggctccgtccctc

SEQ ID NO: 184082 - DNA, 524 bp, Homo sapiens
  Payload ID: 16265
  Gene Symbol: SLC39A3
  Gene Name: solute carrier family 39 (zinc transporter), member 3
  ENST ID: ENST00000589363
  CDS Start-End: 117-524
gtctgtggggtcgagactgcgcggccgttgggcgtgcagcggcgccagtcggcggacgaggggcccccgggagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgaccttccgcaaggagaagccgtccttcatcgacctggagaccttcaacgccggatcggacgtgggcagcgactcggagtatgagagcccc

SEQ ID NO: 184083 - DNA, 491 bp, Homo sapiens
  Payload ID: 16265
  Gene Symbol: SLC39A3
  Gene Name: solute carrier family 39 (zinc transporter), member 3
  ENST ID: ENST00000589166
  CDS Start-End: 169-491
gagtggagacatctgagcagtgacccgaagacctgaatgcagtgagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggcccatcgctcgaaaaagatcctctctctctgcaacacctttggaggaggggtgtttctggccacgtgcttcaacgctctgctgcccgctgtgagggaaaagctccagaaggtcctgagcctcggccacatcagcaccgactacccgctggccgaaaccatcctcctgctgggcttcttcatgaccgtcttcctggagcagctgatcctgacctt

SEQ ID NO: 184084 - DNA, 2297 bp, Homo sapiens
  Payload ID: 16266
  Gene Symbol: SLC39A4
  Gene Name: solute carrier family 39 (zinc transporter), member 4
  ENST ID: ENST00000276833
  CDS Start-End: 305-2173
aaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagatggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcagtcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 184085 - DNA, 2174 bp, Homo sapiens
  Payload ID: 16266
  Gene Symbol: SLC39A4
  Gene Name: solute carrier family 39 (zinc transporter), member 4
  Uniprot ID: Q6P5W5
  ENST ID: ENST00000301305
  CDS Start-End: 107-2050
agccccagtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagatggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcagtcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 184086 - DNA, 583 bp, Homo sapiens
  Payload ID: 16266
  Gene Symbol: SLC39A4
  Gene Name: solute carrier family 39 (zinc transporter), member 4
  ENST ID: ENST00000526658
  CDS Start-End: 31-583
aacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaaggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctg

SEQ ID NO: 184087 - DNA, 2031 bp, Homo sapiens
  Payload ID: 16267
  Gene Symbol: SLC39A5
  Gene Name: solute carrier family 39 (zinc transporter), member 5
  Uniprot ID: Q6ZMH5
  ENST ID: ENST00000266980
  CDS Start-End: 294-1916
agtgaaccattaactcctctcttatgtgagccttcacacactggccccacccctgaccccgccccaaggcaggtgggctaggagggggtgcatgtccatctcagccttctatgtgacgtggcctccgatccacctggacacctggaggctaagcctggattcccccttccctgactcaggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccaagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaa

SEQ ID NO: 184088 - DNA, 871 bp, Homo sapiens
  Payload ID: 16267
  Gene Symbol: SLC39A5
  Gene Name: solute carrier family 39 (zinc transporter), member 5
  ENST ID: ENST00000436633
  CDS Start-End: 155-871
tgtcccccttcctctgggtgtccttgtctcctgctatcaggaactgcttaacgtctacagcaaggcctaataggggacctgagggcacagtcctcaggatgtttcggggagaataggagccagaacctgagcccctaagctattcccctcaccaatgatggggtccccagagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcat

SEQ ID NO: 184089 - DNA, 613 bp, Homo sapiens
  Payload ID: 16267
  Gene Symbol: SLC39A5
  Gene Name: solute carrier family 39 (zinc transporter), member 5
  ENST ID: ENST00000419753
  CDS Start-End: 146-613
ctgcctgcccccccagctggaaccaagaaggttgtgtcccccttcctctgggtgtccttgtctcctgctatcagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgag

SEQ ID NO: 184090 - DNA, 559 bp, Homo sapiens
  Payload ID: 16267
  Gene Symbol: SLC39A5
  Gene Name: solute carrier family 39 (zinc transporter), member 5
  ENST ID: ENST00000424625
  CDS Start-End: 189-559
ctgcctgcccccccagctggaaccaagaaggttgtgtcccccttcctctgggtgtccttgtctcctgctatcaggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaa

SEQ ID NO: 184091 - DNA, 1968 bp, Homo sapiens
  Payload ID: 16267
  Gene Symbol: SLC39A5
  Gene Name: solute carrier family 39 (zinc transporter), member 5
  Uniprot ID: Q6ZMH5
  ENST ID: ENST00000454355
  CDS Start-End: 231-1853
agctggaaccaagaaggttgtgtcccccttcctctgggtgtccttgtctcctgctatcagggcttcccctttcttggtcatcgatccctagagctctggctctttctcttcttggggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccaagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaa

SEQ ID NO: 184092 - DNA, 588 bp, Homo sapiens
  Payload ID: 16267
  Gene Symbol: SLC39A5
  Gene Name: solute carrier family 39 (zinc transporter), member 5
  ENST ID: ENST00000437277
  CDS Start-End: 211-588
atgtgacgtggcctccgatccacctggacacctggaggctaagcctggattcccccttccctgactcaggaactgcttaacgtctacagcaaggcctaataggggacctgaggtgacagctcttatgttgccagtagggggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccct

SEQ ID NO: 184093 - DNA, 569 bp, Homo sapiens
  Payload ID: 16267
  Gene Symbol: SLC39A5
  Gene Name: solute carrier family 39 (zinc transporter), member 5
  ENST ID: ENST00000417965
  CDS Start-End: 184-569
ggaaccaagaaggttgtgtcccccttcctctgggtgtccttgtctcctgctatcagggcttcccctttcttggtcatcgatccctagagctctggctctttctcttcttgggggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctacc

SEQ ID NO: 184094 - DNA, 3543 bp, Homo sapiens
  Payload ID: 16268
  Gene Symbol: SLC39A6
  Gene Name: solute carrier family 39 (zinc transporter), member 6
  Uniprot ID: Q13433
  ENST ID: ENST00000269187
  CDS Start-End: 215-2482
gaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttg

SEQ ID NO: 184095 - DNA, 1657 bp, Homo sapiens
  Payload ID: 16268
  Gene Symbol: SLC39A6
  Gene Name: solute carrier family 39 (zinc transporter), member 6
  Uniprot ID: Q13433
  ENST ID: ENST00000440549
  CDS Start-End: 309-1610
cgaagggggcggtggttccccgcggcgctgcgcgcggcggtaattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagactgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattc

SEQ ID NO: 184096 - DNA, 3003 bp, Homo sapiens
  Payload ID: 16268
  Gene Symbol: SLC39A6
  Gene Name: solute carrier family 39 (zinc transporter), member 6
  Uniprot ID: Q13433
  ENST ID: ENST00000590986
  CDS Start-End: 291-2558
gggggcggtggttccccgcggcgctgcgcgcggcggtaattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagacgtgagtctttcaggaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagagcacgagcatcactctgaccatgatcatcactctcaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaa

SEQ ID NO: 184097 - DNA, 823 bp, Homo sapiens
  Payload ID: 16268
  Gene Symbol: SLC39A6
  Gene Name: solute carrier family 39 (zinc transporter), member 6
  ENST ID: ENST00000586829
  CDS Start-End: 5-823
tttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactctggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggta

SEQ ID NO: 184098 - DNA, 2153 bp, Homo sapiens
  Payload ID: 16269
  Gene Symbol: SLC39A7
  Gene Name: solute carrier family 39 (zinc transporter), member 7
  Uniprot ID: Q92504
  ENST ID: ENST00000374675
  CDS Start-End: 118-1527
atattggtaaaggcattagggcgaaggtggaacggaacttcctgttctcgcgggatctaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaca

SEQ ID NO: 184099 - DNA, 2409 bp, Homo sapiens
  Payload ID: 16269
  Gene Symbol: SLC39A7
  Gene Name: solute carrier family 39 (zinc transporter), member 7
  Uniprot ID: Q92504
  ENST ID: ENST00000374677
  CDS Start-End: 374-1783
tcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccaca

SEQ ID NO: 184100 - DNA, 2409 bp, Homo sapiens; identical to SEQ ID NO: 184099
  Payload ID: 16269
  Gene Symbol: SLC39A7
  Gene Name: solute carrier family 39 (zinc transporter), member 7
  Uniprot ID: Q92504
  ENST ID: ENST00000383213
  CDS Start-End: 374-1783

SEQ ID NO: 184101 - DNA, 2153 bp, Homo sapiens; identical to SEQ ID NO: 184098
  Payload ID: 16269
  Gene Symbol: SLC39A7
  Gene Name: solute carrier family 39 (zinc transporter), member 7
  Uniprot ID: Q92504
  ENST ID: ENST00000383214
  CDS Start-End: 118-1527

SEQ ID NO: 184102 - DNA, 2153 bp, Homo sapiens; identical to SEQ ID NO: 184098
  Payload ID: 16269
  Gene Symbol: SLC39A7
  Gene Name: solute carrier family 39 (zinc transporter), member 7
  Uniprot ID: Q92504
  ENST ID: ENST00000423043
  CDS Start-End: 118-1527

SEQ ID NO: 184103 - DNA, 1015 bp, Homo sapiens
  Payload ID: 16269
  Gene Symbol: SLC39A7
  Gene Name: solute carrier family 39 (zinc transporter), member 7
  ENST ID: ENST00000414757
  CDS Start-End: 354-1015
gggaggaagggcgggcgagcggcccaagacatgatccctggctgagagtagggataccgaagaggtcccagggattcccaaggattgatcggaggattagctgagcacgaggaagcccctgagagaaagactctggcctggattgggtcgaattaagcccgtcgctctgctcagtaccaaaatgacagcgccaatgtggcagccatctttgtacagacgggaagtctcggcgcgagttcccgccccctcgtctagttggaaaccgaggaggcggtctcctccggcctgttagcccgcctcgcccaccctcccctcaaatcacctccacactcgcgcatgcgtgtcagtgcaggatggattcgtcgctaccggagtgccgccatattggtaaaggcattagggcgaaggtggaacggaacttcctgttctcgcgggatctaaaggcgggactgccacgtccaagcaaaccgggaaaggagaggatcccggagccggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaag

SEQ ID NO: 184104 - DNA, 2409 bp, Homo sapiens; identical to SEQ ID NO: 184099
  Payload ID: 16269
  Gene Symbol: SLC39A7
  Gene Name: solute carrier family 39 (zinc transporter), member 7
  Uniprot ID: Q92504
  ENST ID: ENST00000441854
  CDS Start-End: 374-1783

SEQ ID NO: 184105 - DNA, 1015 bp, Homo sapiens; identical to SEQ ID NO: 184103
  Payload ID: 16269
  Gene Symbol: SLC39A7
  Gene Name: solute carrier family 39 (zinc transporter), member 7
  ENST ID: ENST00000444757
  CDS Start-End: 354-1015

SEQ ID NO: 184106 - DNA, 2153 bp, Homo sapiens; identical to SEQ ID NO: 184098
  Payload ID: 16269
  Gene Symbol: SLC39A7
  Gene Name: solute carrier family 39 (zinc transporter), member 7
  Uniprot ID: Q92504
  ENST ID: ENST00000416369
  CDS Start-End: 118-1527

SEQ ID NO: 184107 - DNA, 1015 bp, Homo sapiens; identical to SEQ ID NO: 184103
  Payload ID: 16269
  Gene Symbol: SLC39A7
  Gene Name: solute carrier family 39 (zinc transporter), member 7
  ENST ID: ENST00000454420
  CDS Start-End: 354-1015

SEQ ID NO: 184108 - DNA, 1015 bp, Homo sapiens; identical to SEQ ID NO: 184103
  Payload ID: 16269
  Gene Symbol: SLC39A7
  Gene Name: solute carrier family 39 (zinc transporter), member 7
  ENST ID: ENST00000429042
  CDS Start-End: 354-1015

SEQ ID NO: 184109 - DNA, 2153 bp, Homo sapiens; identical to SEQ ID NO: 184098
  Payload ID: 16269
  Gene Symbol: SLC39A7
  Gene Name: solute carrier family 39 (zinc transporter), member 7
  Uniprot ID: Q92504
  ENST ID: ENST00000443773
  CDS Start-End: 118-1527

SEQ ID NO: 184110 - DNA, 2409 bp, Homo sapiens; identical to SEQ ID NO: 184099
  Payload ID: 16269
  Gene Symbol: SLC39A7
  Gene Name: solute carrier family 39 (zinc transporter), member 7
  Uniprot ID: Q92504
  ENST ID: ENST00000431735
  CDS Start-End: 374-1783

SEQ ID NO: 184111 - DNA, 1015 bp, Homo sapiens; identical to SEQ ID NO: 184103
  Payload ID: 16269
  Gene Symbol: SLC39A7
  Gene Name: solute carrier family 39 (zinc transporter), member 7
  ENST ID: ENST00000425069
  CDS Start-End: 354-1015

SEQ ID NO: 184112 - DNA, 2153 bp, Homo sapiens; identical to SEQ ID NO: 184098
  Payload ID: 16269
  Gene Symbol: SLC39A7
  Gene Name: solute carrier family 39 (zinc transporter), member 7
  Uniprot ID: Q92504
  ENST ID: ENST00000441953
  CDS Start-End: 118-1527

SEQ ID NO: 184113 - DNA, 2409 bp, Homo sapiens; identical to SEQ ID NO: 184099
  Payload ID: 16269
  Gene Symbol: SLC39A7
  Gene Name: solute carrier family 39 (zinc transporter), member 7
  Uniprot ID: Q92504
  ENST ID: ENST00000456261
  CDS Start-End: 374-1783

SEQ ID NO: 184114 - DNA, 2409 bp, Homo sapiens; identical to SEQ ID NO: 184099
  Payload ID: 16269
  Gene Symbol: SLC39A7
  Gene Name: solute carrier family 39 (zinc transporter), member 7
  Uniprot ID: Q92504
  ENST ID: ENST00000418477
  CDS Start-End: 374-1783

SEQ ID NO: 184115 - DNA, 1015 bp, Homo sapiens; identical to SEQ ID NO: 184103
  Payload ID: 16269
  Gene Symbol: SLC39A7
  Gene Name: solute carrier family 39 (zinc transporter), member 7
  ENST ID: ENST00000414916
  CDS Start-End: 354-1015

SEQ ID NO: 184116 - DNA, 2317 bp, Homo sapiens
  Payload ID: 16269
  Gene Symbol: SLC39A7
  Gene Name: solute carrier family 39 (zinc transporter), member 7
  ENST ID: ENST00000612440
  CDS Start-End: 286-1575
ctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttgaacctcattctcaccacactctggagcaacccggacatggacactcccacagtggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggcgatgcgtctgcaactactgacagcagtaggggcactggcaggcacagccgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgcccc

SEQ ID NO: 184117 - DNA, 2317 bp, Homo sapiens; identical to SEQ ID NO: 184116
  Payload ID: 16269
  Gene Symbol: SLC39A7
  Gene Name: solute carrier family 39 (zinc transporter), member 7
  ENST ID: ENST00000617885
  CDS Start-End: 286-1575

SEQ ID NO: 184118 - DNA, 2317 bp, Homo sapiens; identical to SEQ ID NO: 184116
  Payload ID: 16269
  Gene Symbol: SLC39A7
  Gene Name: solute carrier family 39 (zinc transporter), member 7
  ENST ID: ENST00000617579
  CDS Start-End: 286-1575

SEQ ID NO: 184119 - DNA, 2317 bp, Homo sapiens; identical to SEQ ID NO: 184116
  Payload ID: 16269
  Gene Symbol: SLC39A7
  Gene Name: solute carrier family 39 (zinc transporter), member 7
  ENST ID: ENST00000616353
  CDS Start-End: 286-1575

SEQ ID NO: 184120 - DNA, 2317 bp, Homo sapiens; identical to SEQ ID NO: 184116
  Payload ID: 16269
  Gene Symbol: SLC39A7
  Gene Name: solute carrier family 39 (zinc transporter), member 7
  ENST ID: ENST00000612544
  CDS Start-End: 286-1575

SEQ ID NO: 184121 - DNA, 2317 bp, Homo sapiens; identical to SEQ ID NO: 184116
  Payload ID: 16269
  Gene Symbol: SLC39A7
  Gene Name: solute carrier family 39 (zinc transporter), member 7
  ENST ID: ENST00000619171
  CDS Start-End: 286-1575

SEQ ID NO: 184122 - DNA, 3144 bp, Homo sapiens
  Payload ID: 16270
  Gene Symbol: SLC39A8
  Gene Name: solute carrier family 39 (zinc transporter), member 8
  Uniprot ID: Q9C0K1
  ENST ID: ENST00000356736
  CDS Start-End: 384-1766
ccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 184123 - DNA, 3238 bp, Homo sapiens
  Payload ID: 16270
  Gene Symbol: SLC39A8
  Gene Name: solute carrier family 39 (zinc transporter), member 8
  Uniprot ID: Q9C0K1
  ENST ID: ENST00000394833
  CDS Start-End: 478-1860
agtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 184124 - DNA, 4032 bp, Homo sapiens
  Payload ID: 16270
  Gene Symbol: SLC39A8
  Gene Name: solute carrier family 39 (zinc transporter), member 8
  Uniprot ID: Q9C0K1
  ENST ID: ENST00000424970
  CDS Start-End: 317-1651
acttctaagtttgcggcggagagaataaagcagaaagacaggaagaggaggtggagttctacagctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaagataatcaaatgggctactgatgacatcaaatctcaacttcatttactttggatatatacggcaaggtagtaatttcattatctggagtatttcacctccacatctctgcaataccagcaccttcaacagtgattggttagaggttggcatatgacatagttatgaccattgagacgtgatgctgtgtgtgctgtgaagtttctcaaaaggagtaaggaagatacagcctcttctttctagggactttgtttgtaggtgtgacacctggagcagccattttgctactgttttgtttctaattgtgttccccgccgccctccccgctcgccccgaaaaacgacatgtttgagttctaatccccagtatttcagaatgtgaccttatttggaaatagagtcattgcaaatgtaatttgttaagatgagctcatactggagtagagtgggttcctgatctagtatgactggtattcttattaaaaagagaaatttgaatactagctacaccatgtaaagatgaaggcagagatcgtggtgatgcatctacaatgtcaacaattgccagcaaatcatcagaatctgggagagaggtatggaatgaattctctctcgcagccctaagaaggaaccaatcctgtgcacacctgaatcttggacttccagcctccacaactgtgagacaatacatttttgttatttaagctacccagttgtggcactttattactgcagttctagccgactaatacagctaccttgagaggaaatagcatggggatgaaggtgatgtgctgaagaagcacagcagaaagtggaaagatggtccatgaggacatccttagccactgaattgacaagcctcttccctggagtccctcttccttgggattttttttggtgtgtgtaataatcacttttcctaatggtgcaaaccattgtgagttgctctttgactgctagtaattaaagcaaactaaccaagtcagccctccccagtgttcctttttgcaatctaaattctgatgtccaactcctccctgggccactccctgtccccagatgtctctttgtatatctaaagaagaaaaagaaggataaatcctttttctcccaagagatctccctgcttttgtgaaaagcacaaagaagggcattatctaacttttctcatcattagaagtcaagcctggccgtgactcccgttatgacattttgatggccacattttatgagaaaagcccaaacagacagacctgtctgtaaattctttcatcctttgcattctttctttgactgtaccttagagagtgtttgattattgcaggggagatggaaaagaagcaggttctggcctatgctctagttcctcactttctggagttatcttttgggcctggagtctcttggagtgaggaaaggaagccatttttatactttacttatggtagagttaaacttcgtactcttaggaggctacatgcaatctccaagaggaagagagtgaagaggttaagaattatgccatcaaaatgtgctgctctggcatattgactatttgaattacagatattttaaaaacatcagatatgaagaggtcactctgatcttaattctgtgtcttaacagcaggagatgaaattcccacatgggagatggcctccctgtcacagaaggaataccattctccctatcaatgatgagaaattggaactgagagaattctgtatagaccttgttcaagtaattcttctattttaaacctccccacataatttagctgccttttcaaaactactgtcctttgtgcaaccagtatagaagcgattgactctcactgcatccttgggtcttcttttccctatatgggctcttttcccatatgggctcttatgtcctgtaaaacatgtattaaataaatttgtatgcttttctcccgttaacctgtcttacatcaatttaattcttgggcccaggtaggaccctaagaggacagaggtcgagttttgccacctctgcaagagaaaagagagatgcccagaccaccaggcctgggaaatctttgatttcccaggctttgaagtgggcactgtgtctgaacctggccctctgaaacttcctgttcctggacatcccagctgctaatgtgagttgcccttgcactggctcagggctgggacattaaaggaatttcccttttgttgacataacagtaggatggctatagctaacaataatatattatttagtttcaagtagctagaaggaacatatgaatgttcccaacacaaagaaatgacaactatttgagatgatggatatgctaataaccttaatctgattcctatacattatatgcatcacatatacatacattatatgtataacatcactatgtaccccataaatatgtgcaattattgtcaattaaacaaataaatttaaacaaacatt

SEQ ID NO: 184125 - DNA, 2737 bp, Homo sapiens
  Payload ID: 16271
  Gene Symbol: SLC39A11
  Gene Name: solute carrier family 39, member 11
  Uniprot ID: Q8N1S5
  ENST ID: ENST00000255559
  CDS Start-End: 95-1102
gaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtgga

SEQ ID NO: 184126 - DNA, 2752 bp, Homo sapiens
  Payload ID: 16271
  Gene Symbol: SLC39A11
  Gene Name: solute carrier family 39, member 11
  Uniprot ID: Q8N1S5
  ENST ID: ENST00000542342
  CDS Start-End: 90-1118
gactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtgg

SEQ ID NO: 184127 - DNA, 574 bp, Homo sapiens
  Payload ID: 16271
  Gene Symbol: SLC39A11
  Gene Name: solute carrier family 39, member 11
  ENST ID: ENST00000578620
  CDS Start-End: 498-574
actgcgggagtggagccggcgagagagtggcagcgggggctgatggaagtgcagtgggggctggagagggcaccctagtgagttggcttttctctccttcggtgcctttggttgggctcgaggcccggggtcggaggccatcaggacaagagtgtgggacttggaagggcagccacctggagcttggaagggggttgggtggtccgcggaccacgctttgagtagcgaggcattagagaacttttccacagtcctctccgcccagacctgaatccttctgctggattccccctcgtggagttagggcatgtgtgtgcagctccactaaggcccagcagccctagtgctgtttccacttctgcaacttcaccagcctcttgaactgactcttggaagcggaacaacaggtttaaaagggggagaaaggaaataaagaaaacaaacctgtatcaatcagccgggaatgcccatgtgctgctgtggcagctgtatccagcatgctccaaggccacagctctgtgttccaggccttgctggggaccttcttcacctgggggatgacagcagctggggc

SEQ ID NO: 184128 - DNA, 794 bp, Homo sapiens
  Payload ID: 16271
  Gene Symbol: SLC39A11
  Gene Name: solute carrier family 39, member 11
  ENST ID: ENST00000580557
  CDS Start-End: 194-794
ggagccggcgagagagtggcagcgggggctgatggaagtgcagtgggggctggagagggcaccctagtgagttggcttttctctccttcggtgcctttggttgggctcgaggcccggggtcggaggccatcaggacaagagtgtgggacttggaagggcagccacctggagcttggaaggggctgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccag

SEQ ID NO: 184129 - DNA, 589 bp, Homo sapiens
  Payload ID: 16271
  Gene Symbol: SLC39A11
  Gene Name: solute carrier family 39, member 11
  ENST ID: ENST00000583715
  CDS Start-End: 1-374
acaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagctgcagcttgcacatcaggagacctgcttgccagaaggtggacctgtttggaccctcagtgtacaccaatggcttggtctcccacaggggaatggacccagggaagaggactatgcaggccctgtcagtggagtggggattccactactttggatggagaattccagagggctgggtatccagagtgtggtcacatcccatgacctgtgatccttgcctcatgagaaggggcccgtctgtgaggcctggcctcggagtcccttttgcctcagtctgagggagatactgagtttctcagatgaaaacatcaccaggactgtctttcttgagttgaacttgatcttttaaattcattcctttgagttgtacttagctaaaatgtggatatccctatacattatattgttttgacctctaa

SEQ ID NO: 184130 - DNA, 526 bp, Homo sapiens
  Payload ID: 16271
  Gene Symbol: SLC39A11
  Gene Name: solute carrier family 39, member 11
  ENST ID: ENST00000579018
  CDS Start-End: 407-526
gtgtgcgggagggaagcaggaagtgactgcgggagtggagccggcgagagagtggcagcgggggctgatggaagtgcagtgggggctggagagggcaccctagttgggtggtccgcggaccacgctttgagtagcgaggcattagagaacttttccacagtcctctccgcccagacctgaatccttctgctggattccccctcgtggagttagggcatgtgtgtgcagctccactaaggcccagcagccctagtgctgtttccacttctgcaacttcaccagcctcttgaactgactcttggaagcggaacaacaggtttaaaagggggagaaaggaaataaagaaaacaaacctgtatcaatcagccgggaatgcccatgtgctgctgtggcagctgtatccagcatgctccaaggccacagctctgtgttccaggccttgctggggaccttcttcacctgggggatgacagcagctggggcagctctcgtgttcgtattctctagtggacagaggcggatctta

SEQ ID NO: 184131 - DNA, 386 bp, Homo sapiens
  Payload ID: 16271
  Gene Symbol: SLC39A11
  Gene Name: solute carrier family 39, member 11
  ENST ID: ENST00000581581
  CDS Start-End: 1-189
gcacagcccggcggcagcagctggaggaggatcgcactgctcatcttggccatcactatacacaacgttccagagggtctcgctgttggagttggatttggggctatagaaaagacggcatctgctacctttgagagtgccagggtcttgaacttggtttcctgccctggacttaacctgccttcctgacaccgactgacttcacctctccccatgccctcatgtcatgtcttatctgttcctattgtggatccgggattccttggcctgtcccttggcctgctgctgatcatatctccactctgacccacaatatagattttcaaggtaaaaatttttttaaaaaatgtttcactctgttgtctagtaaaatacatgaatgtgta

SEQ ID NO: 184132 - DNA, 532 bp, Homo sapiens
  Payload ID: 16271
  Gene Symbol: SLC39A11
  Gene Name: solute carrier family 39, member 11
  ENST ID: ENST00000583146
  CDS Start-End: 63-532
acattccattcctgggtccttttgcttgtccttgctgactgtcctgtgcagctgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtga

SEQ ID NO: 184133 - DNA, 567 bp, Homo sapiens
  Payload ID: 16271
  Gene Symbol: SLC39A11
  Gene Name: solute carrier family 39, member 11
  ENST ID: ENST00000582769
  CDS Start-End: 11-567
gctttctgccatgactgtgaggcctccccagccatgtggaactggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccgg

SEQ ID NO: 184134 - DNA, 439 bp, Homo sapiens
  Payload ID: 16271
  Gene Symbol: SLC39A11
  Gene Name: solute carrier family 39, member 11
  ENST ID: ENST00000579319
  CDS Start-End: 1-205
gagaaagaaggcggcagccactggccttccagagggtcctgctgtccctgtgccttctcgagggaatctggcacagcccggcggcagcagctggaggaggatcgcactgctcatcttggccatcactatacacaacgttccaggacgtgtttgcttcaccttctgccatgattgtaagtttcctgaggcctccccagctgtgtgaaactagggtctcgctgttggagttggatttggggctatagaaaagacggcatctgctacctttgagagtgccagggtcttgaacttggtttcctgccctggacttaacctgccttcctgacaccgactgacttcacctctccccatgccctcatgtcatgtcttatctgttcctattgtggatccgggattccttggcctgtcccttggcctgctgctgatcatatctccactc

SEQ ID NO: 184135 - DNA, 747 bp, Homo sapiens
  Payload ID: 16271
  Gene Symbol: SLC39A11
  Gene Name: solute carrier family 39, member 11
  ENST ID: ENST00000584129
  CDS Start-End: 10-255
ctttctgccatgactgtgaggcctccccagccatgtggaactggtgcagcagaagacccccagacgaccctggcactgaacttcggctctacgttgatgaagaagaagtctgatcctgagggtcccgcgctgctcttccctgagagtgaactttccatccggataggtagagctgggcttctttcaggcaagctctttgctgcagacactgagctgagtcaggcaatatggacgtgggggctggtggtaggatgaatagtgagagaaatgccagcactgtcctatccctccgaatcactcaccctactactgcatggagctaaactggcatctggcccagcaccttcatttctcatttgttgtccaaaccacatgcttagtctacagaagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccaggtttccatttagctgcaagaaacagcactgtatttttcaaagcactagaaaattctgtggccagtccagaaagacaaaacatagcaccagtgtggcaagaagtggagctaatgcagcattaatgatcctggatgtttctgcactttcttattagaatttaccattcacctctaagcttcagctctg

SEQ ID NO: 184136 - DNA, 1004 bp, Homo sapiens
  Payload ID: 16271
  Gene Symbol: SLC39A11
  Gene Name: solute carrier family 39, member 11
  ENST ID: ENST00000579732
  CDS Start-End: 83-766
ggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagtagagacaagggtgttgctgtgttggccagggtggcctcgaactgctggcctcaagagaacctcctgcttcagcctcccatagtgctgagattataggtgtaagccactgtacccaacctaccactattcctgaatactctcatcaccctgtaaagaaaccccacactctttgagcagtacctctgaggaaaaaaagaaactgcatgcttattagcagtcactccccattcctccctccctccagcccctgcactaatctactttgtctctacagtttccctaaccgggactgactttcatttaaacggtatcatgtaata

SEQ ID NO: 184137 - DNA, 73 bp, Homo sapiens
  Payload ID: 16271
  Gene Symbol: SLC39A11
  Gene Name: solute carrier family 39, member 11
  ENST ID: ENST00000632138
  CDS Start-End: 1-73
gcacagcccggcggcagcagctggaggaggatcgcactgctcatcttggccatcactatacacaacgttccag

SEQ ID NO: 184138 - DNA, 171 bp, Homo sapiens
  Payload ID: 16271
  Gene Symbol: SLC39A11
  Gene Name: solute carrier family 39, member 11
  ENST ID: ENST00000633145
  CDS Start-End: 1-171
acaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccag

SEQ ID NO: 184139 - DNA, 171 bp, Homo sapiens; identical to SEQ ID NO: 184138
  Payload ID: 16271
  Gene Symbol: SLC39A11
  Gene Name: solute carrier family 39, member 11
  ENST ID: ENST00000633890
  CDS Start-End: 1-171

SEQ ID NO: 184140 - DNA, 171 bp, Homo sapiens; identical to SEQ ID NO: 184138
  Payload ID: 16271
  Gene Symbol: SLC39A11
  Gene Name: solute carrier family 39, member 11
  ENST ID: ENST00000632745
  CDS Start-End: 1-171

SEQ ID NO: 184141 - DNA, 492 bp, Homo sapiens
  Payload ID: 16271
  Gene Symbol: SLC39A11
  Gene Name: solute carrier family 39, member 11
  ENST ID: ENST00000633986
  CDS Start-End: 1-254
acaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagtagagacaagggtgttgctgtgttggccagggtggcctcgaactgctggcctcaagagaacctcctgcttcagcctcccatagtgctgagattataggtgtaagccactgtacccaacctaccactattcctgaatactctcatcaccctgtaaagaaaccccacactctttgagcagtacctctgaggaaaaaaagaaactgcatgcttattagcagtcactccccattcctccctccctccagcccctgcactaatctactttgtctctacagtttccctaaccgggactgactttcatttaaacggtatcatgtaata

SEQ ID NO: 184142 - DNA, 143 bp, Homo sapiens
  Payload ID: 16271
  Gene Symbol: SLC39A11
  Gene Name: solute carrier family 39, member 11
  ENST ID: ENST00000632060
  CDS Start-End: 1-143
gagaaagaaggcggcagccactggccttccagagggtcctgctgtccctgtgccttctcgagggaatctggcacagcccggcggcagcagctggaggaggatcgcactgctcatcttggccatcactatacacaacgttccag

SEQ ID NO: 184143 - DNA, 171 bp, Homo sapiens; identical to SEQ ID NO: 184138
  Payload ID: 16271
  Gene Symbol: SLC39A11
  Gene Name: solute carrier family 39, member 11
  ENST ID: ENST00000632654
  CDS Start-End: 1-171

SEQ ID NO: 184144 - DNA, 19 bp, Homo sapiens
  Payload ID: 16271
  Gene Symbol: SLC39A11
  Gene Name: solute carrier family 39, member 11
  ENST ID: ENST00000632054
  CDS Start-End: 1-19
acaagagtgagaatggtga

SEQ ID NO: 184145 - DNA, 171 bp, Homo sapiens; identical to SEQ ID NO: 184138
  Payload ID: 16271
  Gene Symbol: SLC39A11
  Gene Name: solute carrier family 39, member 11
  ENST ID: ENST00000632080
  CDS Start-End: 1-171

SEQ ID NO: 184146 - DNA, 3560 bp, Homo sapiens
  Payload ID: 16272
  Gene Symbol: SLC39A9
  Gene Name: solute carrier family 39, member 9
  Uniprot ID: Q9NUM3
  ENST ID: ENST00000336643
  CDS Start-End: 679-1602
gaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtc

SEQ ID NO: 184147 - DNA, 2377 bp, Homo sapiens
  Payload ID: 16272
  Gene Symbol: SLC39A9
  Gene Name: solute carrier family 39, member 9
  Uniprot ID: Q9NUM3
  ENST ID: ENST00000555840
  CDS Start-End: 633-1556
ccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgc

SEQ ID NO: 184148 - DNA, 855 bp, Homo sapiens
  Payload ID: 16272
  Gene Symbol: SLC39A9
  Gene Name: solute carrier family 39, member 9
  Uniprot ID: Q9NUM3
  ENST ID: ENST00000557046
  CDS Start-End: 1-855
atggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaa

SEQ ID NO: 184149 - DNA, 2065 bp, Homo sapiens
  Payload ID: 16272
  Gene Symbol: SLC39A9
  Gene Name: solute carrier family 39, member 9
  Uniprot ID: Q9NUM3
  ENST ID: ENST00000556605
  CDS Start-End: 681-1379
atgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcatacctt

SEQ ID NO: 184150 - DNA, 5192 bp, Homo sapiens
  Payload ID: 16272
  Gene Symbol: SLC39A9
  Gene Name: solute carrier family 39, member 9
  ENST ID: ENST00000031146
  CDS Start-End: 679-1404
gaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgaggatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgc

SEQ ID NO: 184151 - DNA, 3701 bp, Homo sapiens
  Payload ID: 16272
  Gene Symbol: SLC39A9
  Gene Name: solute carrier family 39, member 9
  ENST ID: ENST00000628474
  CDS Start-End: 679-957
gaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggtgttgagaataataggcagtcagaaggtctgcatgccaaaggcagaagacatttgggaattttttcatcatgaactttaagttgaaggagttaatgattggctggattacaatataaaaagtggatgtctttacagtaaagaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtc

SEQ ID NO: 184152 - DNA, 4965 bp, Homo sapiens
  Payload ID: 16273
  Gene Symbol: SLC4A1
  Gene Name: solute carrier family 4 (anion exchanger), member 1 (Diego blood group)
  Uniprot ID: P02730
  ENST ID: ENST00000262418
  CDS Start-End: 157-2892
gctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttggagtggc

SEQ ID NO: 184153 - DNA, 3855 bp, Homo sapiens
  Payload ID: 16273
  Gene Symbol: SLC4A1
  Gene Name: solute carrier family 4 (anion exchanger), member 1 (Diego blood group)
  ENST ID: ENST00000399246
  CDS Start-End: 150-1787
gaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 184154 - DNA, 1433 bp, Homo sapiens
  Payload ID: 16273
  Gene Symbol: SLC4A1
  Gene Name: solute carrier family 4 (anion exchanger), member 1 (Diego blood group)
  ENST ID: ENST00000631130
  CDS Start-End: 619-729
gggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttgga

SEQ ID NO: 184155 - DNA, 2959 bp, Homo sapiens
  Payload ID: 16274
  Gene Symbol: SLC4A1AP
  Gene Name: solute carrier family 4 (anion exchanger), member 1, adaptor protein
  Uniprot ID: Q9BWU0
  ENST ID: ENST00000326019
  CDS Start-End: 283-2673
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccccgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaa

SEQ ID NO: 184156 - DNA, 906 bp, Homo sapiens
  Payload ID: 16274
  Gene Symbol: SLC4A1AP
  Gene Name: solute carrier family 4 (anion exchanger), member 1, adaptor protein
  ENST ID: ENST00000427424
  CDS Start-End: 1-474
acccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaagatggggttttgccatgttgcacagactggtttcgcgctccttaactcaagctgtcatcccgcctcagcctcccaaagtgttaggattacaggcgtgagccactgctaggaacttgagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattg

SEQ ID NO: 184157 - DNA, 2966 bp, Homo sapiens
  Payload ID: 16274
  Gene Symbol: SLC4A1AP
  Gene Name: solute carrier family 4 (anion exchanger), member 1, adaptor protein
  Uniprot ID: Q9BWU0
  ENST ID: ENST00000613058
  CDS Start-End: 283-2673
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccccgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgttcct

SEQ ID NO: 184158 - DNA, 819 bp, Homo sapiens
  Payload ID: 16274
  Gene Symbol: SLC4A1AP
  Gene Name: solute carrier family 4 (anion exchanger), member 1, adaptor protein
  ENST ID: ENST00000613517
  CDS Start-End: 1-819
atggctgacattctctctcagtcagagaccctggcgtcgcaagacctcagtggggacttcaagaagccagctctgccggtgtccccagcggcgcggagtaaggccccggccagcagttcttcaaaccctgaggagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggtt

SEQ ID NO: 184159 - DNA, 2544 bp, Homo sapiens
  Payload ID: 16274
  Gene Symbol: SLC4A1AP
  Gene Name: solute carrier family 4 (anion exchanger), member 1, adaptor protein
  ENST ID: ENST00000618046
  CDS Start-End: 27-2255
ggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccccgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgt

SEQ ID NO: 184160 - DNA, 3969 bp, Homo sapiens
  Payload ID: 16275
  Gene Symbol: SLC4A2
  Gene Name: solute carrier family 4 (anion exchanger), member 2
  ENST ID: ENST00000310317
  CDS Start-End: 335-3814
gccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagggccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccc

SEQ ID NO: 184161 - DNA, 3947 bp, Homo sapiens
  Payload ID: 16275
  Gene Symbol: SLC4A2
  Gene Name: solute carrier family 4 (anion exchanger), member 2
  Uniprot ID: P04920
  ENST ID: ENST00000392826
  CDS Start-End: 94-3792
gctattggtcacactggcccagaggggcacgtgactgggaaggggcacaggctggtcccctccccctccttctcaggttcacccctgccggccatggacttcctcctgcggcctcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccc

SEQ ID NO: 184162 - DNA, 4142 bp, Homo sapiens
  Payload ID: 16275
  Gene Symbol: SLC4A2
  Gene Name: solute carrier family 4 (anion exchanger), member 2
  Uniprot ID: P04920
  ENST ID: ENST00000413384
  CDS Start-End: 257-3982
acggtgcgccggggggcgcgcacgcagggggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaccta

SEQ ID NO: 184163 - DNA, 610 bp, Homo sapiens
  Payload ID: 16275
  Gene Symbol: SLC4A2
  Gene Name: solute carrier family 4 (anion exchanger), member 2
  ENST ID: ENST00000488420
  CDS Start-End: 400-610
attatcactccctccctcatctttgttgctttctctccgggcctgggccttgactcctttctccctcatttttcttgcggcctttcccacctcctctctcctcctccctctactcagcctctcggcccttttcggcccccctcgcctcagtcctctcctgtctccttgttcttctcttttcttcctataaataactctcctctgtgctgtggctgccgctaagggccactctgaggcccttcatactccaggaggatccccagcagcgcagcctgcgcgtggtggctcctgccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagact

SEQ ID NO: 184164 - DNA, 571 bp, Homo sapiens
  Payload ID: 16275
  Gene Symbol: SLC4A2
  Gene Name: solute carrier family 4 (anion exchanger), member 2
  ENST ID: ENST00000483786
  CDS Start-End: 136-571
aagccaggaaatgcctcctgagagaggtgaaggcagcgtctcagtatgcaagggaagggattcagggtgaaggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctg

SEQ ID NO: 184165 - DNA, 702 bp, Homo sapiens
  Payload ID: 16275
  Gene Symbol: SLC4A2
  Gene Name: solute carrier family 4 (anion exchanger), member 2
  ENST ID: ENST00000490898
  CDS Start-End: 196-702
agaccacccctcccctccggcccccccgcatagtccttcagtcccgtccggggcgcccagactgggggttgcccggggcccccatccccaatctccgggttgagaggcgaagccaggaaaggcgggtggcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggacc

SEQ ID NO: 184166 - DNA, 793 bp, Homo sapiens
  Payload ID: 16275
  Gene Symbol: SLC4A2
  Gene Name: solute carrier family 4 (anion exchanger), member 2
  ENST ID: ENST00000463414
  CDS Start-End: 342-793
cttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctc

SEQ ID NO: 184167 - DNA, 4387 bp, Homo sapiens
  Payload ID: 16275
  Gene Symbol: SLC4A2
  Gene Name: solute carrier family 4 (anion exchanger), member 2
  Uniprot ID: P04920
  ENST ID: ENST00000461735
  CDS Start-End: 548-4231
ccggccatggacttcctcctgcggcctcaggtgcgaggggtctgcgaccctctctccccatggcggcaagctccctgcgcctctccccgtcccctcgtcccacggggctgcttctggtgggagtggggctgggcgcttaggggagccaggagatggacaggagccttcctcacagaggggagaagccagccccctggcccgctcaccttctcttatccggtgttctgccagtcccagctgctccagtccccacctcgcccctaagacccgcccttcaccccagccctccccgcgctcttccttgttctggctgctggcaccgctatggagggggctgcatacccccgcccttggagatcccgatgcccttcaggtccagaagctcttgagcaaatatttggcggcgcctggagctgagaccgtgggtgggtggggggctggaccaaggctgcctggccaggcggctgccgcttagctgggctgagctcttacaagcgccgcattccctgccggctgtgccggccggccgctgctccgcgcccgcaggatgactcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 184168 - DNA, 500 bp, Homo sapiens
  Payload ID: 16275
  Gene Symbol: SLC4A2
  Gene Name: solute carrier family 4 (anion exchanger), member 2
  ENST ID: ENST00000482950
  CDS Start-End: 118-500
ataaagctctgcccagcccatgcccaccttctgtgccttcctctctctcagtgagttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatga

SEQ ID NO: 184169 - DNA, 4925 bp, Homo sapiens
  Payload ID: 16275
  Gene Symbol: SLC4A2
  Gene Name: solute carrier family 4 (anion exchanger), member 2
  Uniprot ID: P04920
  ENST ID: ENST00000485713
  CDS Start-End: 1041-4766
cccagccctcttgaaaagggccgctccgggactacgcgttccagaatgcagcggaaatgggggcggagcgctctcggttaggggtttggggtttggcggcctagatcccgggcactggcggcccagcgctgacctggttggtggcattgtgttcccaacggcctcttgacgacctcagcacgggtttccacctctccccaagccacctagtgaccccagaattgactggggaatgcctgtgagcgatgatgacctcacagggaacagctgaccgcagggctgggagaacagctgtgccccttcgaggctggattttagtggagggacacacgccaaagaccccctctctgctgagccccgtttgttgtctcggagcccacccgactctagccgctgaactctgacatgctgaggaaaactgggtggagccctgggggtccccctcagaccccagtctccggaacagggcccactggagtcagccagggtgtggcaggcaggttggttaaccccctccacagacaagaccacagaccgatgctcaacttgcagcagcctctgcctcaccccttaaaggagctgattatagattcccttacgctgcctctctaattgtctcatgattgcattcttgagggctatggaccgagggaaaaggatcccaaacagcactcctcagcaccggaaccagagttgctgctaaacacgtgttaattaactcgtttctatctgaatgcttttgcatacacaagggaaaagaagcaaaaagtgtattccttatctggaagactttgtgatttcgttgggcaaaaaagaactacacacaaaggtcttgaatgataagtgatggctctgcctagggttcggttcagtgtggaggttccattcaagaggaaggaggccagcacagcgaatctctgtccctctctggaagtggagagcctctaacaagttaccctctcccagatcagctcagggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacct

SEQ ID NO: 184170 - DNA, 4246 bp, Homo sapiens
  Payload ID: 16276
  Gene Symbol: SLC4A3
  Gene Name: solute carrier family 4 (anion exchanger), member 3
  Uniprot ID: P48751
  ENST ID: ENST00000273063
  CDS Start-End: 215-3994
gcggagcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctca

SEQ ID NO: 184171 - DNA, 4069 bp, Homo sapiens
  Payload ID: 16276
  Gene Symbol: SLC4A3
  Gene Name: solute carrier family 4 (anion exchanger), member 3
  Uniprot ID: P48751
  ENST ID: ENST00000317151
  CDS Start-End: 119-3817
gcagtcgcggctgcgctcgggagagagcgcgggggacatggggcgcggcggcccgcctgggcctcgcaggctccggagccccgagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctca

SEQ ID NO: 184172 - DNA, 4454 bp, Homo sapiens
  Payload ID: 16276
  Gene Symbol: SLC4A3
  Gene Name: solute carrier family 4 (anion exchanger), member 3
  Uniprot ID: P48751
  ENST ID: ENST00000358055
  CDS Start-End: 513-4211
ggggaggggaggctaaaagcagggttggggagcgaatctgggggattgtgggaatatcgggccgcgccccagcccccagcgatgcgtggggcgcctggagaaggggcgcacgggcaggtggggtgctgcggggcccgcgcgtgggggccgcgccggccggggcggggtgagtcacggcccgcccgctcccattgtgcggcccggcggcggcggcggcggcggcggcggcggcggaggtgcggagcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 184173 - DNA, 4134 bp, Homo sapiens
  Payload ID: 16276
  Gene Symbol: SLC4A3
  Gene Name: solute carrier family 4 (anion exchanger), member 3
  Uniprot ID: P48751
  ENST ID: ENST00000373760
  CDS Start-End: 193-3891
cccagcccccagcgatgcgtggggcgcctggagaaggggcgcacgggcaggtggggtgctgcggggcccgcgcgtgggggccgcgccggccggggcgggggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 184174 - DNA, 3936 bp, Homo sapiens
  Payload ID: 16276
  Gene Symbol: SLC4A3
  Gene Name: solute carrier family 4 (anion exchanger), member 3
  ENST ID: ENST00000425141
  CDS Start-End: 213-1769
gccagcccggctctgcgctgcgagaggccggacggcagtcgcggctgcgctcgggagagagcgcgggggacatggggcgcggcggcccgcctgggcctcgcaggctccggagccccgagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagccctattccagttctgcgtcctcagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtga

SEQ ID NO: 184175 - DNA, 547 bp, Homo sapiens
  Payload ID: 16276
  Gene Symbol: SLC4A3
  Gene Name: solute carrier family 4 (anion exchanger), member 3
  ENST ID: ENST00000444906
  CDS Start-End: 1-223
ggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtggctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtaccc

SEQ ID NO: 184176 - DNA, 1862 bp, Homo sapiens
  Payload ID: 16276
  Gene Symbol: SLC4A3
  Gene Name: solute carrier family 4 (anion exchanger), member 3
  ENST ID: ENST00000416910
  CDS Start-End: 1-622
ggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagttctgcgtcctcagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaggcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccg

SEQ ID NO: 184177 - DNA, 792 bp, Homo sapiens
  Payload ID: 16276
  Gene Symbol: SLC4A3
  Gene Name: solute carrier family 4 (anion exchanger), member 3
  ENST ID: ENST00000413743
  CDS Start-End: 110-792
ccaccttcagctctggttggacagaagccaccccgtccaggctcccaccttgtaggagagccgaggggtctggtagggagcggaggccgaggtctcggccaccgggagaatgacgagcccactggagaaggaccctgagcccaatggggcactgagccctgggcctggggataccaatagctggggctttgggagggatccagcccccagtcctcgagactcactggccccggaagacttagagatgtttgtgctggactttgaggatggtgacctgtgggagtccatcaggggccagctgggccccatggcagggccaccaacttgtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacag

SEQ ID NO: 184178 - DNA, 5323 bp, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENST ID: ENST00000264485
  CDS Start-End: 118-3357
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccac

SEQ ID NO: 184179 - DNA, 3771 bp, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENST ID: ENST00000351898
  CDS Start-End: 77-3064
ggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaac

SEQ ID NO: 184180 - DNA, 7640 bp, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENST ID: ENST00000340595
  CDS Start-End: 197-3304
aggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 184181 - DNA, 7596 bp, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENST ID: ENST00000425175
  CDS Start-End: 118-3402
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgatgagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 184182 - DNA, 2316 bp, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENST ID: ENST00000512686
  CDS Start-End: 197-2137
aggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccaggtgagggcattacgctttgtgtttatgctcgctttgtatttggaggaaggtgtaggctccatgcttgcaaattttcaacatgctgtcatggtcctcaggaattagtcttgtttttttctctgaaaaactctgctactgaatttgatgtctcattgcctgaggtattttagctgtatgattcaaccaggaaggagaccaggagctctggaatgtgaacataaccaactcaatattttgaaattaactcaaactgtgggatttgcaaggaattcatgtgtacattattcttgattttataagtggggaaacctggatacatgtattaacagatataaatatgtgacaaacc

SEQ ID NO: 184183 - DNA, 6233 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000346834
  CDS Start-End: 237-3650
tttcaccttcctgcagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 184184 - DNA, 3142 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000358683
  CDS Start-End: 50-3109
gcctccctgggatttggatcctggtttccagagctaagaacacaaagtcatgaaggtgaaggaggagaaggctggggtaggaaagctggaccacactaaccacaggaggagatttccggatcagaaagggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaag

SEQ ID NO: 184185 - DNA, 3123 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000377632
  CDS Start-End: 1-3123
atgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctga

SEQ ID NO: 184186 - DNA, 3814 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000377634
  CDS Start-End: 401-3814
ccaccctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctga

SEQ ID NO: 184187 - DNA, 6348 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000394019
  CDS Start-End: 399-3764
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtca

SEQ ID NO: 184188 - DNA, 6185 bp, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENST ID: ENST00000423644
  CDS Start-End: 237-3602
tttcaccttcctgcagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 184189 - DNA, 727 bp, Homo sapiens
  Payload ID: 16278
  Gene Symbol: SLC4A5
  Gene Name: solute carrier family 4 (sodium bicarbonate cotransporter), member 5
  ENST ID: ENST00000436454
  CDS Start-End: 339-727
aaggtccaccctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtgtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaa

SEQ ID NO: 184190 - DNA, 3073 bp, Homo sapiens
  Payload ID: 16278
  Gene Symbol: SLC4A5
  Gene Name: solute carrier family 4 (sodium bicarbonate cotransporter), member 5
  ENST ID: ENST00000425249
  CDS Start-End: 183-3073
tggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgtctctctccaccacagatcctgggcctcatcatcgttcgaaggcttctggatttcatcttttcccagcacgacctggcctggattgacaacatc

SEQ ID NO: 184191 - DNA, 552 bp, Homo sapiens
  Payload ID: 16278
  Gene Symbol: SLC4A5
  Gene Name: solute carrier family 4 (sodium bicarbonate cotransporter), member 5
  ENST ID: ENST00000444570
  CDS Start-End: 119-552
atactgttcagcctggaaaccacagagagcccttcttgccacccaacaggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaagg

SEQ ID NO: 184192 - DNA, 905 bp, Homo sapiens
  Payload ID: 16278
  Gene Symbol: SLC4A5
  Gene Name: solute carrier family 4 (sodium bicarbonate cotransporter), member 5
  ENST ID: ENST00000432728
  CDS Start-End: 540-905
agtgcacctgagatttctctctcaccctctcacttctctctctctcttgctcacttctctctctctctctctctctctctctcacttctctgtctctctctctgtctctctctctctcagatctttaattaactcagtgtagcttttctctctcaaacacttttgcataatctttctcacacttacacttaccacacctatattctctctacatatagcctctctctccacctccccagtccttcacacattccttttctctctctctttttctcccctcaaaccccccttcttctctccccacacctcccctggtgcttaactggaaacaaaagtgagtttgttgtgtgaagaagaggacctgtggaagtagcagccagggaggcagcagcggaagcaggctggggccagaggcagcatcgacagccagggaccccagcgctcagctgttccagggagcagggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccaca

SEQ ID NO: 184193 - DNA, 7757 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000295736
  CDS Start-End: 72-3716
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 184194 - DNA, 3224 bp, Homo sapiens
  Payload ID: 16279
  Gene Symbol: SLC4A7
  Gene Name: solute carrier family 4, sodium bicarbonate cotransporter, member 7
  ENST ID: ENST00000428179
  CDS Start-End: 72-3224
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggagtctgcctcctggcactgtagttgtggcacactgggtgtgggactcaagaggcccgctgttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagag

SEQ ID NO: 184195 - DNA, 4159 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000454389
  CDS Start-End: 222-4001
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184196 - DNA, 3667 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000437179
  CDS Start-End: 222-3509
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184197 - DNA, 7970 bp, Homo sapiens
  Payload ID: 16279
  Gene Symbol: SLC4A7
  Gene Name: solute carrier family 4, sodium bicarbonate cotransporter, member 7
  ENST ID: ENST00000425128
  CDS Start-End: 322-3927
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttctcgtgaggattacagtgaggactagggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatagcagggatttgaactcaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccaggcaatgttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaattagt

SEQ ID NO: 184198 - DNA, 4000 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000446700
  CDS Start-End: 222-3842
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184199 - DNA, 4061 bp, Homo sapiens
  Payload ID: 16279
  Gene Symbol: SLC4A7
  Gene Name: solute carrier family 4, sodium bicarbonate cotransporter, member 7
  ENST ID: ENST00000445684
  CDS Start-End: 271-3903
gccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184200 - DNA, 3825 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000438530
  CDS Start-End: 222-1946
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184201 - DNA, 3775 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000455077
  CDS Start-End: 222-3617
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184202 - DNA, 3600 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000457377
  CDS Start-End: 222-1613
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184203 - DNA, 3407 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000437266
  CDS Start-End: 295-1686
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatag

SEQ ID NO: 184204 - DNA, 6447 bp, Homo sapiens
  Payload ID: 16279
  Gene Symbol: SLC4A7
  Gene Name: solute carrier family 4, sodium bicarbonate cotransporter, member 7
  ENST ID: ENST00000419036
  CDS Start-End: 1-2406
gtaatggaagtggtggaagcagagaaaatagtactgttgacttcagcaaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 184205 - DNA, 4120 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000440156
  CDS Start-End: 222-3962
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 184206 - DNA, 7385 bp, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENST ID: ENST00000428386
  CDS Start-End: 72-3344
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 184207 - DNA, 11731 bp, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENST ID: ENST00000358657
  CDS Start-End: 284-3406
attcatctcgtaagcgccaaggtggaggggggtcctaccgagggaggagctacaggccaccgcgaccagcagagagcgaaggcaggagggaccagcctggcccagccccttcattttactgtcgggggtagtgaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgaggatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggatccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattgaattttgcattccttagacttttaaaatatactaatgtattctagtcttactctaaagacctttgatgttaaaggaatccttcatttatttcatattccctatctcatagggccacaattattttaatacagagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtgggtattgttcctggtttgtctcatttctatcacaaggctgttttgggcacagccttagcttcctttcatatatatatggtgcagacaggataggtcatgcttcttggaacctatatgggcattaaaatcttcatgagccaaagcttcacattttagcactttaggataactgtagtaattgtactcatttacctacctaattgggaagaattaaaaggcagcccatctggaggataagctttcttgcagacttttcccttgtccctctctggctgcctccttgagcttgccactttttcatcttcattgttccctgagaacatctcccctttcttgctctatcttgcccctcccatcttttcctgccacctctgtgtggggaggttgatgaccatttcacctctttccctagcctcagcacagctgtaaggagtgtatcaaaactgggtgagagtatcactcagaaaaatgcctcccctaacacacggatgtcttgtgctgccttgaccgcttgaggggaggagccttcattaactctgtgtagtgcaggtacaggaccacctgtgcactttagggtacttctcgagctagaccctcctggatcactgcgccttaggaatgttagctactttttaaaaaaaatatgatttggtgcgttgttggggtgaactccatggggaagattgtgagtgaagatgggaaggaatttgggtggttttgccacgaggtgatggttggggttgggcgaatgggttggatgatcctggctctgtgggtgtggtgctcggttgcctccgtacagttgcagttcacctttgtgcatggtgattaccagtcactctagggattgtaggtcccaacagcggttccagcagcctgcacagctggtacgaggacagctggaggagggtctgatatccctgcaagtgatgcaggataaaacttcccggccgggcgcaatggctcgcgcctgtaatcccagcactttgggaggccaagatgggcggatcacgaggtcaggagatcgagaccatcctggctaacgtggtgaaaccccgtctctactaaaaatacaaaaaaattagctgggcatggtggcgggcgcctgtagtcccagctattcaggaggctgaggcagaatggcgtgaacgcgggaggcagagcttgcagtgagccgagatcatgccactgcactccagcctgggtgacagagcaagactccatttcaaaaaaaaaaaaaaaaaaaaacttcccaataggaggtattccttgatggctctcgaatgcatgaatgatatatcaatttgaagtttctcgacctttccatcaaggatcttgaattttttctcaattatgcttgctaatgtgtcaaaggccaagtacactgtatcaaacttgccgtctgtaagatgcaagatcaatctagtgtttcagccagttcactactgacatcagactcaactttgtcccctctctttcttttcatgcaagagactttaagggtaacctcttcagttgaaactgtcttggaagtgcagccctcctcctgtgtggctagagaaagagatggcaccaggatctcttaacggcaagtgctcacggggcatgggtgattttgtctagtctggtccttttggacgtggtgatttcctgtcatcctcgtggtctgacattgcttctcactggatactggttgtggcctttgactcattagctgattgttggatctctttgtgaggttcgattttttaaaaatccatgggtccctatggactgtcacctgttgcagatgatggtgattctcttcttttttttgtctccaatagttgcctggacgacttcatgggtcagtccacatgattgcaggatttcccattgttcatctgtgaatgttgattggccaacctgtctgagctttcagcagatgcatccttgagcttactttcaggaattcctcctggaattggttttccttggtggtaatttctcatggtggagcttgtttctgaggcatggtacagtgctgcggaggcaaggcaaggctgtcatggtgattttcacagcatctggatggcaaattgccttcacgtagggaaaccacatgggactgatagctttctcaagggatctccaagcatctctgaatttggggatttcatcagttactcctggaatcaaaatgagtgtggagtcataatatatattttttttgagacaaagtctcactctgtcgcccaggctggagtgcagtggtgcgatctcatctcactgcaacctctgcctcctgggttcaagtgattctcctgcctcagcctcccaagtagctaggattacaggtgcgcaccaccatgcccagctaatttttgtattttagtagagacgaagtttcactatgttggccaggctggtctgaaactcctggcctcaggtgatccacccacctcagcctcccaaagtgctgggattacaggtatgagccactgcccctggcctcaaaatctttaaggaagttatttatcgtcacaagtgttgtcatctgtgactcatgggccacttgatgaacctgaaccattagtggttgtccagatcctccaactttttcaggcagtattccaatcagggttttacgacaccagggtatcccaccttttttgcaacataggcagaaacaccaagctgtgggtaattgatgtgcgtgtcactgattcctgcaacagctttgaatgtattaaatctgttttcaacagcccttgcataggtgttatctctcaaatctctgtaaagagcactaagagtatgtagtgttgcatgatataatccaagcctgtgggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttgaaggccatgccaacccttttaggccattaaatttttctcaaacaatagccagcctcatttctgcttcatctctgtggtaggaaccattccctactcttactccctcctcttgtccaacttccaccaaacactcaatccgagtcctggctgctttcttgcttaggtctgtggctggtcactgtggtgaaagagtcaaggtgggcagtgtttggggtaggaaatgagtagtggtgaagcagcagcagtgtgtgtgtgggtgtgggtgtgtgtgcatgcgtgtgcatttgcatgtgtgtatgttgacaaatgagagtgtagccataagatttcattgttactactagtctttgtgtacctatctggagggacattaaaaaaatatggccattctcccatctagggggttcccatctcagacttctctgataagagtaatttgagaacaaatacagattcatctatgggaaaagatgtttaaactcagcatgaaggagaaacaaatttaggagtggaaagcaaggcaggtagttaggtgatttccatgaccacatttgcttgggccagggaagtggtgcacctcttttataacaatgggagatttcagaaacagtttgagtgttggcagaccaatgccctgataagcttgtggtatagaggtaggaagggagggaggccagagattagataaaatgatggtgggtgggatcttagctctaaatgaaaagaactggacttactaagtgggtggattacttgctagccataacttttagggaagggtaggtctggagagaaggtgaagaccagcagaaatatactgtgaaattgccaaatatgtttggttgcagaaaacacagcctggctctttgtggctagatgtgacttccaacttctgaagacaggattgccaagagatgtgatctttccacatacagctcctgtccccatctctttatgtgtagagacctggatttggggtagtggggtagtaaaccatatatttccaaaagatggtgtgaagagtcgtttctcttcgtctgggatgtgattggcttttgttttttgttttttgtttttgagacggagtctcgctctgtcgctttgtcaccaggctggagtgcaatggcacaatctcagctcactgcaacctccgcctcctggcttcaagtgattctcctgcctcagcctcctgagtagctgggactataggcgcgcaccaccatgcccagctaatttttgtatttttagtagagatgggatttcaccatgttggccaggatggtcttgatctcttgacctcatgatccacccgccttggcctcccaaagtgctgggattacaggcttgagctactgcgcccggccagtgattggcttttaaattaatcacaaatgtttgataaaattctggtatgtgctaagtcccaggcttggttgatatctcagactatgatagctgtgaccttcaagaaatttctggcttggggaatctgtagtttctggttgtccaaaaaagatagttcttagtcctactttattttctacccactcaactctccagacttccctcttagtaaaggaattcataattctccctgcatcttctctgtttatttcaatgtccatgttctgagtctcaagttttcctgaagcacaggagcaggcttggccccagagcccctggctttttcaacgagcatcagaaatgctatcaatatattctctctgttgctttatcagcttctctaaatttattttgtaaggaagttagcacctccttccaggactttaaacagttgtctttgccaatttgttcctggattttccttgaacttctcaggtttccaagccacatcctagcagggcatccaggagccttgcactgaacctctcagctcttttgactttcttctggtcataggtgttgggcctcccattaggtagaagtcctttgagcagacccgaaatggccaaatgagacatcatccaagttcctccctcctttactgtctcggctttttcaagcacccctttcacctctcttttctgccttttcctcagtctgtcaagttctttggaggaaagaagttcttggtcagaggtcctaaaaccaccaccagctgggggtgctgagaatggtgaggagttggacagtcccggggcttttttgaaaggggactttatggtcatttcccctgtttagggtgagggactaagaattctcaagccttcagtttcatccatatttcaatgtaagcagaaaagcacatctcaaagccaaatagaaatgattttctactaagcctatcctttgtgattcttggttcccttggtctcttaatattaattatagagaatgggcagttgagtcagttaacatcttttcatcagaaaggagggtaatattcataaccaaaagagatgtaaaggaagtatattactgcttgaagtgtgaaaagaggaaaggagtgttatgtgaaccttttcagtagggaaattcagaaaatggaatgattcatccataggcataattcttttaggagattctgtgctcaaagggaagggaatggtttctgatccttctgaagagaaaaggaatagcatttttcttaaacctaacccagtttcagcattggagaatacagaactttttcttctagctgatggcattaatatttcttgagagagagaactcacccatggcacttttctgagcccagcagaaatcagcggagcttgggcttcgcttagcaggtttgcaattgacttcaacatgcaggcttttcacatgtgcaataatgctggaaacagaagcaccaaactgattgtgcaattactccttttgtagaagaggccaaaatcctcctcctccttcctttctcctatattcactcctccaggatcataaagcctccctcttgtttatctgtgtctgtctgtctgattggttagatttggctgcccttccaagctaatggtgtcaggtggagaacagagcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcgtggtctgtgtctgtgaaccagggcaggtaattgtgacactgcatctcatagaactctgcctgcccagatttttgtgtgctcacctcaatgggtgaaaaataaagtctgtgtaaactgtt

SEQ ID NO: 184208 - DNA, 11824 bp, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENST ID: ENST00000453097
  CDS Start-End: 218-3499
gtgctccgcgccctgattggctgcgcaggcctctcgctgattggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctagatatctgggaaagatttgataatagttgtttgtgaatagaaaggaggatatgatgtttttattggccattttgcgggactcttcgacttcttgctgctgtctcttgaggatacattccaattccatcctggcgagatccaagtgcttacgtactgtctccttagctgccttagagtaaacgatcatcagttcaatggaccaaaatcaccttcagccatgtggtttcttcatcatcatggatttcttttggttgacaaacattctggctctcagatgcaaaaagtcacactgggaaatgaactgtaagtggtgaaattagttttggtatttaatttaaaactacatttatagtttttctcttctcttctatgttgcaatgaatgtaaagtatttgggatccagtgcttataaacctttccttcctttgtgcacagaatgtaactagcaagcccattagcacccagataattctatcatgttagtttcccatcctggaaaatctttgtacagtgggaagttccccgatgtgtttttctttcttaggtgaagggttggctatatcactttattgaattttgcattccttagacttttaaaatatactaatgtattctagtcttactctaaagacctttgatgttaaaggaatccttcatttatttcatattccctatctcatagggccacaattattttaatacagagatgattttcaaaatattttaacaactggtacaggacagatgccagccactcagaagggatgcctgctgtaaacaagcagtatgtatggttgtaccaatgcctattggctgaacattatgctactttcagatattaaaatggtgttcctttgaatcgtgggtattgttcctggtttgtctcatttctatcacaaggctgttttgggcacagccttagcttcctttcatatatatatggtgcagacaggataggtcatgcttcttggaacctatatgggcattaaaatcttcatgagccaaagcttcacattttagcactttaggataactgtagtaattgtactcatttacctacctaattgggaagaattaaaaggcagcccatctggaggataagctttcttgcagacttttcccttgtccctctctggctgcctccttgagcttgccactttttcatcttcattgttccctgagaacatctcccctttcttgctctatcttgcccctcccatcttttcctgccacctctgtgtggggaggttgatgaccatttcacctctttccctagcctcagcacagctgtaaggagtgtatcaaaactgggtgagagtatcactcagaaaaatgcctcccctaacacacggatgtcttgtgctgccttgaccgcttgaggggaggagccttcattaactctgtgtagtgcaggtacaggaccacctgtgcactttagggtacttctcgagctagaccctcctggatcactgcgccttaggaatgttagctactttttaaaaaaaatatgatttggtgcgttgttggggtgaactccatggggaagattgtgagtgaagatgggaaggaatttgggtggttttgccacgaggtgatggttggggttgggcgaatgggttggatgatcctggctctgtgggtgtggtgctcggttgcctccgtacagttgcagttcacctttgtgcatggtgattaccagtcactctagggattgtaggtcccaacagcggttccagcagcctgcacagctggtacgaggacagctggaggagggtctgatatccctgcaagtgatgcaggataaaacttcccggccgggcgcaatggctcgcgcctgtaatcccagcactttgggaggccaagatgggcggatcacgaggtcaggagatcgagaccatcctggctaacgtggtgaaaccccgtctctactaaaaatacaaaaaaattagctgggcatggtggcgggcgcctgtagtcccagctattcaggaggctgaggcagaatggcgtgaacgcgggaggcagagcttgcagtgagccgagatcatgccactgcactccagcctgggtgacagagcaagactccatttcaaaaaaaaaaaaaaaaaaaaacttcccaataggaggtattccttgatggctctcgaatgcatgaatgatatatcaatttgaagtttctcgacctttccatcaaggatcttgaattttttctcaattatgcttgctaatgtgtcaaaggccaagtacactgtatcaaacttgccgtctgtaagatgcaagatcaatctagtgtttcagccagttcactactgacatcagactcaactttgtcccctctctttcttttcatgcaagagactttaagggtaacctcttcagttgaaactgtcttggaagtgcagccctcctcctgtgtggctagagaaagagatggcaccaggatctcttaacggcaagtgctcacggggcatgggtgattttgtctagtctggtccttttggacgtggtgatttcctgtcatcctcgtggtctgacattgcttctcactggatactggttgtggcctttgactcattagctgattgttggatctctttgtgaggttcgattttttaaaaatccatgggtccctatggactgtcacctgttgcagatgatggtgattctcttcttttttttgtctccaatagttgcctggacgacttcatgggtcagtccacatgattgcaggatttcccattgttcatctgtgaatgttgattggccaacctgtctgagctttcagcagatgcatccttgagcttactttcaggaattcctcctggaattggttttccttggtggtaatttctcatggtggagcttgtttctgaggcatggtacagtgctgcggaggcaaggcaaggctgtcatggtgattttcacagcatctggatggcaaattgccttcacgtagggaaaccacatgggactgatagctttctcaagggatctccaagcatctctgaatttggggatttcatcagttactcctggaatcaaaatgagtgtggagtcataatatatattttttttgagacaaagtctcactctgtcgcccaggctggagtgcagtggtgcgatctcatctcactgcaacctctgcctcctgggttcaagtgattctcctgcctcagcctcccaagtagctaggattacaggtgcgcaccaccatgcccagctaatttttgtattttagtagagacgaagtttcactatgttggccaggctggtctgaaactcctggcctcaggtgatccacccacctcagcctcccaaagtgctgggattacaggtatgagccactgcccctggcctcaaaatctttaaggaagttatttatcgtcacaagtgttgtcatctgtgactcatgggccacttgatgaacctgaaccattagtggttgtccagatcctccaactttttcaggcagtattccaatcagggttttacgacaccagggtatcccaccttttttgcaacataggcagaaacaccaagctgtgggtaattgatgtgcgtgtcactgattcctgcaacagctttgaatgtattaaatctgttttcaacagcccttgcataggtgttatctctcaaatctctgtaaagagcactaagagtatgtagtgttgcatgatataatccaagcctgtgggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttgaaggccatgccaacccttttaggccattaaatttttctcaaacaatagccagcctcatttctgcttcatctctgtggtaggaaccattccctactcttactccctcctcttgtccaacttccaccaaacactcaatccgagtcctggctgctttcttgcttaggtctgtggctggtcactgtggtgaaagagtcaaggtgggcagtgtttggggtaggaaatgagtagtggtgaagcagcagcagtgtgtgtgtgggtgtgggtgtgtgtgcatgcgtgtgcatttgcatgtgtgtatgttgacaaatgagagtgtagccataagatttcattgttactactagtctttgtgtacctatctggagggacattaaaaaaatatggccattctcccatctagggggttcccatctcagacttctctgataagagtaatttgagaacaaatacagattcatctatgggaaaagatgtttaaactcagcatgaaggagaaacaaatttaggagtggaaagcaaggcaggtagttaggtgatttccatgaccacatttgcttgggccagggaagtggtgcacctcttttataacaatgggagatttcagaaacagtttgagtgttggcagaccaatgccctgataagcttgtggtatagaggtaggaagggagggaggccagagattagataaaatgatggtgggtgggatcttagctctaaatgaaaagaactggacttactaagtgggtggattacttgctagccataacttttagggaagggtaggtctggagagaaggtgaagaccagcagaaatatactgtgaaattgccaaatatgtttggttgcagaaaacacagcctggctctttgtggctagatgtgacttccaacttctgaagacaggattgccaagagatgtgatctttccacatacagctcctgtccccatctctttatgtgtagagacctggatttggggtagtggggtagtaaaccatatatttccaaaagatggtgtgaagagtcgtttctcttcgtctgggatgtgattggcttttgttttttgttttttgtttttgagacggagtctcgctctgtcgctttgtcaccaggctggagtgcaatggcacaatctcagctcactgcaacctccgcctcctggcttcaagtgattctcctgcctcagcctcctgagtagctgggactataggcgcgcaccaccatgcccagctaatttttgtatttttagtagagatgggatttcaccatgttggccaggatggtcttgatctcttgacctcatgatccacccgccttggcctcccaaagtgctgggattacaggcttgagctactgcgcccggccagtgattggcttttaaattaatcacaaatgtttgataaaattctggtatgtgctaagtcccaggcttggttgatatctcagactatgatagctgtgaccttcaagaaatttctggcttggggaatctgtagtttctggttgtccaaaaaagatagttcttagtcctactttattttctacccactcaactctccagacttccctcttagtaaaggaattcataattctccctgcatcttctctgtttatttcaatgtccatgttctgagtctcaagttttcctgaagcacaggagcaggcttggccccagagcccctggctttttcaacgagcatcagaaatgctatcaatatattctctctgttgctttatcagcttctctaaatttattttgtaaggaagttagcacctccttccaggactttaaacagttgtctttgccaatttgttcctggattttccttgaacttctcaggtttccaagccacatcctagcagggcatccaggagccttgcactgaacctctcagctcttttgactttcttctggtcataggtgttgggcctcccattaggtagaagtcctttgagcagacccgaaatggccaaatgagacatcatccaagttcctccctcctttactgtctcggctttttcaagcacccctttcacctctcttttctgccttttcctcagtctgtcaagttctttggaggaaagaagttcttggtcagaggtcctaaaaccaccaccagctgggggtgctgagaatggtgaggagttggacagtcccggggcttttttgaaaggggactttatggtcatttcccctgtttagggtgagggactaagaattctcaagccttcagtttcatccatatttcaatgtaagcagaaaagcacatctcaaagccaaatagaaatgattttctactaagcctatcctttgtgattcttggttcccttggtctcttaatattaattatagagaatgggcagttgagtcagttaacatcttttcatcagaaaggagggtaatattcataaccaaaagagatgtaaaggaagtatattactgcttgaagtgtgaaaagaggaaaggagtgttatgtgaaccttttcagtagggaaattcagaaaatggaatgattcatccataggcataattcttttaggagattctgtgctcaaagggaagggaatggtttctgatccttctgaagagaaaaggaatagcatttttcttaaacctaacccagtttcagcattggagaatacagaactttttcttctagctgatggcattaatatttcttgagagagagaactcacccatggcacttttctgagcccagcagaaatcagcggagcttgggcttcgcttagcaggtttgcaattgacttcaacatgcaggcttttcacatgtgcaataatgctggaaacagaagcaccaaactgattgtgcaattactccttttgtagaagaggccaaaatcctcctcctccttcctttctcctatattcactcctccaggatcataaagcctccctcttgtttatctgtgtctgtctgtctgattggttagatttggctgcccttccaagctaatggtgtcaggtggagaacagagcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcgtggtctgtgtctgtgaaccagggcaggtaattgtgacactgcatctcatagaactctgcctgcccagatttttgtgtgctcacctcaatgggtgaaaaataaagtctgtgtaaactgtt

SEQ ID NO: 184209 - DNA, 2262 bp, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENST ID: ENST00000535225
  CDS Start-End: 284-2200
attcatctcgtaagcgccaaggtggaggggggtcctaccgagggaggagctacaggccaccgcgaccagcagagagcgaaggcaggagggaccagcctggcccagccccttcattttactgtcgggggtagtgaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagctttttaaaaaac

SEQ ID NO: 184210 - DNA, 3041 bp, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENST ID: ENST00000514353
  CDS Start-End: 410-2653
cccgagcccaggcttcccaggccgctccctgagggcgaggggaggccagcccgggacaccagggggcgctccgggcggttggggaccaggccagggctgcgagagagtgaccttgggccgaacctgggatctggcccatctctgccgcatcccttgcgccgcccgcccaggagccctgacagccggcgggcggcgacctcttgttctcctcgcgtctttctgttggaaggggccggcgtctggcctcgcgttgtcctgccagaacgtgggcagaaagggtagcagggaccttgctctgagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagaatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtgctgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttggaaaacataa

SEQ ID NO: 184211 - DNA, 3086 bp, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENST ID: ENST00000432095
  CDS Start-End: 28-2865
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctga

SEQ ID NO: 184212 - DNA, 2838 bp, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENST ID: ENST00000506545
  CDS Start-End: 28-2718
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggg

SEQ ID NO: 184213 - DNA, 3277 bp, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENST ID: ENST00000506757
  CDS Start-End: 36-2915
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgtttgaaata

SEQ ID NO: 184214 - DNA, 3258 bp, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENST ID: ENST00000507527
  CDS Start-End: 23-2974
tctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacg

SEQ ID NO: 184215 - DNA, 3414 bp, Homo sapiens
  Payload ID: 16282
  Gene Symbol: SLC4A10
  Gene Name: solute carrier family 4, sodium bicarbonate transporter, member 10
  ENST ID: ENST00000272716
  CDS Start-End: 94-3414
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagcattgaaagccgaaaagagaagaaagctgactcagggaaaggtgttgacagggagacttgtctatga

SEQ ID NO: 184216 - DNA, 5710 bp, Homo sapiens
  Payload ID: 16282
  Gene Symbol: SLC4A10
  Gene Name: solute carrier family 4, sodium bicarbonate transporter, member 10
  Uniprot ID: Q6U841
  ENST ID: ENST00000375514
  CDS Start-End: 288-3587
gtgcaaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgccctgaagatgctgagacatagagatggctgtgattatcttttgtaagacaggaaatgcagtctttaggggtttctggaaatagaaaggtcatgcagtctggaacctgtgagccttttcaatctctaagtcatcagagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaacttccttgcacattttaaattgtg

SEQ ID NO: 184217 - DNA, 3669 bp, Homo sapiens
  Payload ID: 16282
  Gene Symbol: SLC4A10
  Gene Name: solute carrier family 4, sodium bicarbonate transporter, member 10
  ENST ID: ENST00000446228
  CDS Start-End: 59-1468
gtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggtcaccaatatccggtatcttcgcttctccagagttcttccacagattctgttgctgacatgacttgaagtatccattactcatctgctctcctggagttgctggtgtacatctgggctgctcttgcactgttctctgatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcata

SEQ ID NO: 184218 - DNA, 5551 bp, Homo sapiens
  Payload ID: 16282
  Gene Symbol: SLC4A10
  Gene Name: solute carrier family 4, sodium bicarbonate transporter, member 10
  Uniprot ID: Q6U841
  ENST ID: ENST00000446997
  CDS Start-End: 94-3450
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaact

SEQ ID NO: 184219 - DNA, 5578 bp, Homo sapiens
  Payload ID: 16282
  Gene Symbol: SLC4A10
  Gene Name: solute carrier family 4, sodium bicarbonate transporter, member 10
  Uniprot ID: Q6U841
  ENST ID: ENST00000415876
  CDS Start-End: 182-3448
caaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaacttccttgcacattttaaattgtgatacaaa

SEQ ID NO: 184220 - DNA, 3398 bp, Homo sapiens
  Payload ID: 16282
  Gene Symbol: SLC4A10
  Gene Name: solute carrier family 4, sodium bicarbonate transporter, member 10
  ENST ID: ENST00000421911
  CDS Start-End: 59-3223
gtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaacattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcata

SEQ ID NO: 184221 - DNA, 3094 bp, Homo sapiens
  Payload ID: 16283
  Gene Symbol: SLC4A11
  Gene Name: solute carrier family 4, sodium borate transporter, member 11
  Uniprot ID: Q8NBS3
  ENST ID: ENST00000380056
  CDS Start-End: 49-2724
ctttctccctagggtggcgtgggttgcatccctcggaagagcgaaggaatgagccaggtcggggggcggggagacaggtgcacacaggaggtccagggcttggtccatggggctggtgacctttctgcttcccttgcagaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctccta

SEQ ID NO: 184222 - DNA, 3229 bp, Homo sapiens
  Payload ID: 16283
  Gene Symbol: SLC4A11
  Gene Name: solute carrier family 4, sodium borate transporter, member 11
  Uniprot ID: Q8NBS3
  ENST ID: ENST00000380059
  CDS Start-End: 103-2859
cttccaggcggccgggacgcggtcccaggactggagaccgttgcctgtcggcccccgtgtgacccggggcgcgtgacgggggtcgggggaactgcgcctgcaatgggcgtttatggcccccaggaccggtctgagagtgagaagagggatgtgcagagagatcccccgccttggcatccgaggagagagggggagaggcccgctcgggcccggtcccttcctctcgctgcagcggggcagggttttctcaggaaaacctggattagcgaacatgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctccta

SEQ ID NO: 184223 - DNA, 494 bp, Homo sapiens
  Payload ID: 16283
  Gene Symbol: SLC4A11
  Gene Name: solute carrier family 4, sodium borate transporter, member 11
  ENST ID: ENST00000437836
  CDS Start-End: 181-494
tttaccttccgcccgggcatcttcccgtccggcgccgcggtgggagccccggaacccctggagttttgggagtcccgggacccctgaccgtgccctgcgcggccgcagcggtttctcccttgctctgacacgggagggccagccctgggtccccgccaggacccagaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgt

SEQ ID NO: 184224 - DNA, 2832 bp, Homo sapiens
  Payload ID: 16283
  Gene Symbol: SLC4A11
  Gene Name: solute carrier family 4, sodium borate transporter, member 11
  Uniprot ID: Q8NBS3
  ENST ID: ENST00000539553
  CDS Start-End: 54-2681
agaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgta

SEQ ID NO: 184225 - DNA, 3015 bp, Homo sapiens
  Payload ID: 16283
  Gene Symbol: SLC4A11
  Gene Name: solute carrier family 4, sodium borate transporter, member 11
  ENST ID: ENST00000474451
  CDS Start-End: 226-1950
agaagcgccggagcgccgcgtgaggagcccggccgtgagtgcgcgagtgtgccatggccgcggccaccaggcgcgtgttccatctgcagccgtgcggtgggtgcctgaacccgggggcgcggcgggaaggccgcccgggtctccgccaccgtctcccgtcggggaccccggggagaacgcggatgccgtctgcctgcgcgggccggggccgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaacctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctg

SEQ ID NO: 184226 - DNA, 3442 bp, Homo sapiens
  Payload ID: 16284
  Gene Symbol: SLC40A1
  Gene Name: solute carrier family 40 (iron-regulated transporter), member 1
  Uniprot ID: Q9NP59
  ENST ID: ENST00000261024
  CDS Start-End: 428-2143
gggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaatttttcctgaa

SEQ ID NO: 184227 - DNA, 824 bp, Homo sapiens
  Payload ID: 16284
  Gene Symbol: SLC40A1
  Gene Name: solute carrier family 40 (iron-regulated transporter), member 1
  ENST ID: ENST00000427241
  CDS Start-End: 224-824
aatgagagccagcattcataagaaacttcgcaagagcagtggaatagtgaccattctttattctgcctttgtcctggtgagcacatctgatatggcagaggaaactgaggatgcctggccgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccc

SEQ ID NO: 184228 - DNA, 299 bp, Homo sapiens
  Payload ID: 16284
  Gene Symbol: SLC40A1
  Gene Name: solute carrier family 40 (iron-regulated transporter), member 1
  ENST ID: ENST00000427419
  CDS Start-End: 224-299
atactcatgcgtggctcccttcactactgggtgtcagtctggcctgtgctcaaggtgtggcatctggttggagtttcaatatgtaggatccactaccagggttttcgtgagattaagaaggaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaat

SEQ ID NO: 184229 - DNA, 209 bp, Homo sapiens
  Payload ID: 16284
  Gene Symbol: SLC40A1
  Gene Name: solute carrier family 40 (iron-regulated transporter), member 1
  ENST ID: ENST00000440626
  CDS Start-End: 134-209
attctttattctgcctttgtcctggtgagcacatctgatatggcagaggaaactgaggatgcctggccgcacctcagcgagagcagcagcagcgatagcagccgcagaagagccagcggggtcgcctagtgtcatgaccagggcgggagatcacaaccgccagagaggatgctgtggatccttggccgactacctgacctctgcaaaat

SEQ ID NO: 184230 - DNA, 592 bp, Homo sapiens
  Payload ID: 16284
  Gene Symbol: SLC40A1
  Gene Name: solute carrier family 40 (iron-regulated transporter), member 1
  ENST ID: ENST00000455320
  CDS Start-End: 427-592
acagggcacatactcatgcgtggctcccttcactactgggtgtcagtctggcctgtgctcaaggtgtggcatctggttggagtttcaatatgtaggatccactaccagggttttcgtgagattaagaagggtaaggtaacctactggcaaaaggggctggtatgccccaggggttggtttggcacagcaggattaaaacgaagtcaaccaaggctagagtctggtgttctttagtcattcacctcaccctccaggaggccaccgaatggctttatctggacagggacagatccagggacacaactgggataaccggtattcctgaggtgctatctccagttccttgcactcctgttaacaagcacctcagcgagagcagcagcagcgatagcagccgcagaagagccagcggggtcgcctagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaa

SEQ ID NO: 184231 - DNA, 4997 bp, Homo sapiens
  Payload ID: 16285
  Gene Symbol: SLC41A1
  Gene Name: solute carrier family 41 (magnesium transporter), member 1
  Uniprot ID: Q8IVJ1
  ENST ID: ENST00000367137
  CDS Start-End: 1016-2557
ccaccggcagccaaccagttgggcccgagtccgcgggcaagaagcgattgggggcgcgtgagctcggctccccggtcccccgtccgggtgcccccccgccgggcccgaagcgatatatcctgccctccccggccacctcccccgcgtggaagcggagcggcggcctcgctgtaacgcagaagcgaaatgtagcgagccgggtgtcgcggctggacgctcgccttggctgggggtgtgggggggcacgccgggggccaaggaggactgtcgaggaggagtgatgagaagagggggtgccctgcaccccccgagaccacgggccacgctgccacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtagaggtggtgattgagtctcgggccaacgccaagggggttcgggaggaggacgccctgctggagaacgggagccagagcaacgaaagtgacgacgtcagcacagaccgtggccctgcgccaccttccccgctcaaggagacctccttttccatcgggctgcaagtactgtttccattcctcctggcaggctttgggaccgtggctgctggcatggtgttggacatcgtgcagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaacgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccaaatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttaga

SEQ ID NO: 184232 - DNA, 4449 bp, Homo sapiens
  Payload ID: 16286
  Gene Symbol: SLC41A2
  Gene Name: solute carrier family 41 (magnesium transporter), member 2
  Uniprot ID: Q96JW4
  ENST ID: ENST00000258538
  CDS Start-End: 129-1850
gtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacagcactgggaggtgttcagaaaagttacagaagttttcattttagtccctgcacttcttggtctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttcaaagaagactggtataaatcctgataatgttgctacacccattgctgctagttttggcgaccttataactcttgccatattggcttggataagtcagggcttatactcctgtcttgagacctattactacatttctccattagttggtgtatttttcttggctctaacccctatttggattataatagctgccaaacatccagccacaagaacagttctccactcaggctgggagcctgtcataacagctatggttataagtagcattgggggccttattctggacacaactgtatcagacccaaacttggttgggattgttgtttacacgccagttattaatggtattggtggtaatttggtggccattcaggctagcaggatttctacctacctccatttacatagcattccaggagaattgcctgatgaacccaaaggttgttactacccatttagaactttctttggtccaggagtaaataataagtctgctcaagttctactgcttttagtgattcctggacatttaattttcctctacactattcatttgatgaaaagtggtcatacttctttaactataatcttcatagtagtgtatttatttggcgctgtgttacaggtatttaccttgctgtggattgctgactggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatagacatagatataagttccagctctgaaattaattaggaaagaatataggatgtttacagtgaataattttaaaaccacaaacatagcagaaatgtactttattattaaatttgtaatgcaggattagaagaagcagagctctagtttagcctttcttgtctcacagatgtgctgtatcccaggcatactataaaacgaagagtgcccaaccaagctttgaatcgtattaacaatgcccacctctatgctagctgaggataaatttaccagttgctcatatttaaactgacctaaatatgttttgctgagcataagataaactcacttttacctccatctaaaattatcctgttctgatgccaattcaatttcagctctgcaagttcttgtcaggctaatctttaaacattgagtgatcttgagagattgttaatgaaagcagtgagtcattttttgatgattgatttgttggaaaaatgttgatgtgttttaaaaaatgtaatcttcaaaaacagaatataacctgagatgcatttgtagagacaagacggtacgagaatgtgtgtgtgtgtgtgtgtgagagagagagacttttgatgaagaactaaatcttggattgctgatagcaaagatcatagtgctgttggaatatcagcaatatagagttattcttaaacacattctattaacatgtttttgtcattgggtccaaaaattttgctgctgaccagaatttactatttgttacctatattctttttttttttttttttttttttttttgagacagagtcttgctctgtcgcccaggctggaatgcagtggtgtgatctcggctcactgctacctccacctcctggattcaagtgattctcctgcctcagcctcccgagtagctgggattacaggaatgcgccacaacgcccagctaatttgttacctacactctaattaataattaataatttcttattttaaaaagtagtactatttaatataatcaagataggagatttaaaatgagcaagtgattcatttgctcttttaaagaagcccgttgacttacgcttttaaaaaagaagttggtgggttacctcaattattgttcatgcttaaacatatccatttgtacaggcttatttctacgtgggacccaatcatatatactatatttctcaaataatttttctaaaactctggcctatattctaaacacttgaccaacaccttagttattgaataggtaaccatttttaaagtacatgtggttcattttttaaaattcaatctctcaagaccgttagatatttaataatttaagctgataagggtatcaaaatgcacattaactttgatcatcatgatttaagttgtaactttgtgttattatataaatattaggttgtttataaatatattgcagaaagtattcttgttaagctcttttaaatgaggggactgtggtttagagttatatatttttgcttatttttaaacttcaattattccattcttctgccttataataaaacttttaaggcagagaactgaactaattatagaatttctcctttggagagttataatgttacatagtgaacattcttataaaagaaagaataagtttaagttgatgaatatttagctgcaaagattttttacttaaaaaaatccatgaatatctttgattttattataaagcatttgtaaattatttgcatttgagctgtaagattcataaacatttacatttcccaatgatttctattttgatttttaaaaaatatacagggcaagctacatttttaaagcattaatcaacaactttattatattacacattccagtgcacaaacacacaatatcatttaatactcacagtagtacctgtgaaatatatcagatggatattcctatctctattttacagcagaggaaaccgaaattcagagaacttacatttctaaggttgtacagctgcaaaatgaccaaattgtgaagtccctaacatccaggttttcataatgccagtactctttctatgacatgtttatgaccctccaaatgtaccaaaactacctaactaattcactgagaggaagccaactgcaaaaataggatttttaaaagtacaatagagtattactacattttatggatttcagacaaagaaacctccgtttattatatcctgatggtgagtattgccagctctaaattattcatatttctaagaccaaggaaaatataggtaaatgaaaattttgaaataaagaacaatgccttaatttgtaaaatctatcattgctaccaccctgcccaggtctggccatttgccataaatgctggtaaataaatacaatgactgataga

SEQ ID NO: 184233 - DNA, 447 bp, Homo sapiens
  Payload ID: 16286
  Gene Symbol: SLC41A2
  Gene Name: solute carrier family 41 (magnesium transporter), member 2
  ENST ID: ENST00000437220
  CDS Start-End: 1-447
atgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacaggtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagg

SEQ ID NO: 184234 - DNA, 685 bp, Homo sapiens
  Payload ID: 16286
  Gene Symbol: SLC41A2
  Gene Name: solute carrier family 41 (magnesium transporter), member 2
  ENST ID: ENST00000433540
  CDS Start-End: 458-685
agggggccgcgggcgccgacggccgggctgtcagcttggggccgcagccgcgcgaggaggcgcgggagcaggaaggagctgtgggctgggagccgctgtcctccccgccaccaccggtgccgggcaccagatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagactttt

SEQ ID NO: 184235 - DNA, 563 bp, Homo sapiens
  Payload ID: 16286
  Gene Symbol: SLC41A2
  Gene Name: solute carrier family 41 (magnesium transporter), member 2
  ENST ID: ENST00000417469
  CDS Start-End: 426-563
agtctgcaagaaacatgacctcagccaaaaagaggccgctggtctgagaagagaaatcatgagtcatggattcgggggttcggaccttggagcaggcgatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggtt

SEQ ID NO: 184236 - DNA, 702 bp, Homo sapiens
  Payload ID: 16286
  Gene Symbol: SLC41A2
  Gene Name: solute carrier family 41 (magnesium transporter), member 2
  ENST ID: ENST00000415674
  CDS Start-End: 272-702
gctgtcagcttggggccgcagccgcgcgaggaggcgcgggagcaggaaggagctgtgggctgggagccgctgtcctccccgccaccaccggtgccgggcaccagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctat

SEQ ID NO: 184237 - DNA, 590 bp, Homo sapiens
  Payload ID: 16286
  Gene Symbol: SLC41A2
  Gene Name: solute carrier family 41 (magnesium transporter), member 2
  ENST ID: ENST00000424946
  CDS Start-End: 374-590
gctgtcagcttggggccgcagccgcgcgaggaggcgcgggagcaggaaggagctgtgggctgggagccgctgtcctccccgccaccaccggtgccgggcaccaggtgaatgccccttccatcccccgcccctggtgtctcggtctggtctgaggagacggggacccttctcacaccggccgctgccgccgccgcgctccggaacagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcag

SEQ ID NO: 184238 - DNA, 571 bp, Homo sapiens
  Payload ID: 16286
  Gene Symbol: SLC41A2
  Gene Name: solute carrier family 41 (magnesium transporter), member 2
  ENST ID: ENST00000411411
  CDS Start-End: 206-571
gatcagtggtaaaagaagttacgaacagttcataaaagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggag

SEQ ID NO: 184239 - DNA, 564 bp, Homo sapiens
  Payload ID: 16286
  Gene Symbol: SLC41A2
  Gene Name: solute carrier family 41 (magnesium transporter), member 2
  ENST ID: ENST00000432951
  CDS Start-End: 529-564
cagcttggggccgcagccgcgcgaggaggcgcgggagcaggaaggagctgtgggctgggagccgctgtcctccccgccaccaccggtgccgggcaccaggtgaatgccccttccatcccccgcccctggtgtctcggtctggtctgaggagacggggacccttctcacaccggccgctgccgccgccgcgctccggaacagatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaa

SEQ ID NO: 184240 - DNA, 574 bp, Homo sapiens
  Payload ID: 16286
  Gene Symbol: SLC41A2
  Gene Name: solute carrier family 41 (magnesium transporter), member 2
  ENST ID: ENST00000449866
  CDS Start-End: 291-574
actatgcgctgctgggccgaaagacacgtggttcggttttaactccagtctgcaagaaacatgacctcagccaaaaagaggccgctggtctgagaagagaaatcatgagtcatggattcggggatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttca

SEQ ID NO: 184241 - DNA, 1705 bp, Homo sapiens
  Payload ID: 16287
  Gene Symbol: SLC41A3
  Gene Name: solute carrier family 41, member 3
  Uniprot ID: Q96GZ6
  ENST ID: ENST00000346785
  CDS Start-End: 240-1655
cggctcccagccccccgggcccccggcggggctctgcgctgccggagcttgggcgtctgctgctgtcccggagcgccaagtcgtccgaggtccggccgcccggccggggcggggccagggaggcccggccttcccgcttcctgcctgagccgcaggcccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttga

SEQ ID NO: 184242 - DNA, 1797 bp, Homo sapiens
  Payload ID: 16287
  Gene Symbol: SLC41A3
  Gene Name: solute carrier family 41, member 3
  Uniprot ID: Q96GZ6
  ENST ID: ENST00000315891
  CDS Start-End: 240-1763
cggctcccagccccccgggcccccggcggggctctgcgctgccggagcttgggcgtctgctgctgtcccggagcgccaagtcgtccgaggtccggccgcccggccggggcggggccagggaggcccggccttcccgcttcctgcctgagccgcaggcccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacag

SEQ ID NO: 184243 - DNA, 2169 bp, Homo sapiens
  Payload ID: 16287
  Gene Symbol: SLC41A3
  Gene Name: solute carrier family 41, member 3
  Uniprot ID: Q96GZ6
  ENST ID: ENST00000360370
  CDS Start-End: 45-1508
gcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttgacc

SEQ ID NO: 184244 - DNA, 2330 bp, Homo sapiens
  Payload ID: 16287
  Gene Symbol: SLC41A3
  Gene Name: solute carrier family 41, member 3
  Uniprot ID: Q96GZ6
  ENST ID: ENST00000383598
  CDS Start-End: 287-1672
actgtctgaggagagcctgaccttcagggagggacagcagggcctggcagagtctctgtaatgaggccgtgagtcacactggcctttgttcctcactcatctgtgctggccctcagccgaggggctgttggggaactctctgcaggcacagggcacctggtgactgggaagcttctgtttgtgtggacttcttgggaacagcgtcctggtgtgggccaggaggagaggactggagcaccccaggctctgacttcgtgctcctgggatcgtggtgcattgcctggccatggtggtcacccagctgaatctggagttttgctttcagggcaagaagctgcgaggcttcagctgtgagcttacccggtccccacatggggtcttgcctgaatctttcttcaccatcatgtgccaggtcgtggtgcccattctgctgtccggcttgtgcatgatgacagccggcctggtgatgaacaccattcaacactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 184245 - DNA, 726 bp, Homo sapiens
  Payload ID: 16287
  Gene Symbol: SLC41A3
  Gene Name: solute carrier family 41, member 3
  ENST ID: ENST00000512470
  CDS Start-End: 123-726
gggaggcgcgcgggagagggcgcccgggagtgggtgcgcgggaggcgagtgagccgggcgccgggccctgggggctcggcgggagggggagtcagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggtgagc

SEQ ID NO: 184246 - DNA, 526 bp, Homo sapiens
  Payload ID: 16287
  Gene Symbol: SLC41A3
  Gene Name: solute carrier family 41, member 3
  ENST ID: ENST00000504035
  CDS Start-End: 71-526
cccggtaagcgcggccctgttccgggcggggttggggcggaagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 184247 - DNA, 500 bp, Homo sapiens
  Payload ID: 16287
  Gene Symbol: SLC41A3
  Gene Name: solute carrier family 41, member 3
  ENST ID: ENST00000509452
  CDS Start-End: 244-500
ttaggcattagattctcataaggagcacacaacctagatcccctgcgtgcgcagttcacaatacggtttgagctcctatgaggatctgatgctgccggtgatctgacaggagagggaacctgatcaggcagtgatgctcgccgggagccgctcaccttctgctgtgtggcccagttcccaacgggggttggggacccctgctctaaaggatctcttggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgct

SEQ ID NO: 184248 - DNA, 588 bp, Homo sapiens
  Payload ID: 16287
  Gene Symbol: SLC41A3
  Gene Name: solute carrier family 41, member 3
  ENST ID: ENST00000514333
  CDS Start-End: 176-588
tctttcccgccgccgcctgggaggggacccgagggtttcaccatcttgcctaagctggtcttcaactcctgagctcaagcaatctgcttgcctcggcctcccaaagtgctgggattacaggcatgagccactgcatctggccagatagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgaga

SEQ ID NO: 184249 - DNA, 544 bp, Homo sapiens
  Payload ID: 16287
  Gene Symbol: SLC41A3
  Gene Name: solute carrier family 41, member 3
  ENST ID: ENST00000507280
  CDS Start-End: 89-544
attgctcgggtgaccactggccttggcaagaacagtttgcatcaggagaagaggaggggagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 184250 - DNA, 986 bp, Homo sapiens
  Payload ID: 16287
  Gene Symbol: SLC41A3
  Gene Name: solute carrier family 41, member 3
  ENST ID: ENST00000514677
  CDS Start-End: 105-986
gcttcctgcctgagccgcaggcccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgtaagtggacacctggacattcgaggcggccacaacgtgaggcaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtg

SEQ ID NO: 184251 - DNA, 530 bp, Homo sapiens
  Payload ID: 16287
  Gene Symbol: SLC41A3
  Gene Name: solute carrier family 41, member 3
  ENST ID: ENST00000514891
  CDS Start-End: 75-530
accgggatttgggggactcggtgggggaaaggcgcgcgggagatgagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 184252 - DNA, 580 bp, Homo sapiens
  Payload ID: 16287
  Gene Symbol: SLC41A3
  Gene Name: solute carrier family 41, member 3
  ENST ID: ENST00000510651
  CDS Start-End: 59-580
tctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgtaagtggacacctggacattcgaggcggccacaacgtgaggcaggtgcaggccactgtcgtggggctcttggctgctgtggctgcgctgctgttgggcgtggtgtctcgagaggaagtggatgtcgccaaggtggagttg

SEQ ID NO: 184253 - DNA, 569 bp, Homo sapiens
  Payload ID: 16287
  Gene Symbol: SLC41A3
  Gene Name: solute carrier family 41, member 3
  ENST ID: ENST00000509064
  CDS Start-End: 155-569
aaacagagcttggttttagccagggcgcccactgcagtcacgctggagacctctggtgcagatgggcgagactggacccagctttccagctttcttcccctttccataattctcctgaaagtgtaagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagc

SEQ ID NO: 184254 - DNA, 692 bp, Homo sapiens
  Payload ID: 16287
  Gene Symbol: SLC41A3
  Gene Name: solute carrier family 41, member 3
  ENST ID: ENST00000507008
  CDS Start-End: 212-409
agacacaaacagagcttggttttagccagggcgcccactgcagtcacgctggagacctctggtgcagatgggcgagactggacccagctttccagctttcttcccctttccataattctcctgaaagtgtaagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcag

SEQ ID NO: 184255 - DNA, 923 bp, Homo sapiens
  Payload ID: 16287
  Gene Symbol: SLC41A3
  Gene Name: solute carrier family 41, member 3
  ENST ID: ENST00000513723
  CDS Start-End: 59-923
tctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagggcaagaagctgcgaggcttcagctgtgagcttacccggtccccacatggggtcttgcctgaatctttcttcaccatcatgtgccaggtcgtggtgcccattctgctgtccggcttgtgcatgatgacagccggcctggtgatgaacaccattcaacactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattc

SEQ ID NO: 184256 - DNA, 541 bp, Homo sapiens
  Payload ID: 16287
  Gene Symbol: SLC41A3
  Gene Name: solute carrier family 41, member 3
  ENST ID: ENST00000505996
  CDS Start-End: 60-338
ctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagttctagaggctggaagtccaagatcaaggtgttggcagcattggtttctcctgtggcctctccttggcttgcagacggctgccttttctccgtgtcttcagcactggcctgtgtttgtggaggtgaaagaccttttgacattggtgccgcccctggtgggcctgaaggggaacctggagatgacactggcatccagactctccacagct

SEQ ID NO: 184257 - DNA, 1480 bp, Homo sapiens
  Payload ID: 16287
  Gene Symbol: SLC41A3
  Gene Name: solute carrier family 41, member 3
  Uniprot ID: Q96GZ6
  ENST ID: ENST00000508835
  CDS Start-End: 208-1320
acaaacagagcttggttttagccagggcgcccactgcagtcacgctggagacctctggtgcagatgggcgagactggacccagctttccagctttcttcccctttccataattctcctgaaagtgtaagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctct

SEQ ID NO: 184258 - DNA, 1606 bp, Homo sapiens
  Payload ID: 16287
  Gene Symbol: SLC41A3
  Gene Name: solute carrier family 41, member 3
  Uniprot ID: Q96GZ6
  ENST ID: ENST00000612940
  CDS Start-End: 43-1545
ctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgttagcaaaaacctctatttagatttcaataatcagagaagtgtaaaataaaacagattatattgt

SEQ ID NO: 184259 - DNA, 2598 bp, Homo sapiens
  Payload ID: 16288
  Gene Symbol: SLC43A1
  Gene Name: solute carrier family 43 (amino acid system L transporter), member 1
  Uniprot ID: O75387
  ENST ID: ENST00000278426
  CDS Start-End: 357-2036
gaggggaaaagaagggagcccccgcccccacctcggggcgcagctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagaga

SEQ ID NO: 184260 - DNA, 580 bp, Homo sapiens
  Payload ID: 16288
  Gene Symbol: SLC43A1
  Gene Name: solute carrier family 43 (amino acid system L transporter), member 1
  ENST ID: ENST00000534105
  CDS Start-End: 67-243
aggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgc

SEQ ID NO: 184261 - DNA, 953 bp, Homo sapiens
  Payload ID: 16288
  Gene Symbol: SLC43A1
  Gene Name: solute carrier family 43 (amino acid system L transporter), member 1
  ENST ID: ENST00000524995
  CDS Start-End: 351-527
aaaagaagggagcccccgcccccacctcggggcgcagctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgttcctggtgtcatgtgctgagccctcccttccccctcctcagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaag

SEQ ID NO: 184262 - DNA, 788 bp, Homo sapiens
  Payload ID: 16288
  Gene Symbol: SLC43A1
  Gene Name: solute carrier family 43 (amino acid system L transporter), member 1
  ENST ID: ENST00000530159
  CDS Start-End: 85-600
gccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacggaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcacca

SEQ ID NO: 184263 - DNA, 690 bp, Homo sapiens
  Payload ID: 16288
  Gene Symbol: SLC43A1
  Gene Name: solute carrier family 43 (amino acid system L transporter), member 1
  ENST ID: ENST00000533263
  CDS Start-End: 359-690
gcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggagagctgcgcgtttgccagagttccagcggacctcctggagcgcttgaacccaaagccccgtttcacagatgagaataccgagtccccctggaagaagtgactggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcag

SEQ ID NO: 184264 - DNA, 999 bp, Homo sapiens
  Payload ID: 16288
  Gene Symbol: SLC43A1
  Gene Name: solute carrier family 43 (amino acid system L transporter), member 1
  ENST ID: ENST00000533066
  CDS Start-End: 222-999
tcttggaggggcaactggaagatggggtcgtagggtagccttgaacttgcccttcttcctgccagcttctaggggtctttcctggcgcgagagtccggacatgggcccgcggtgcttcagagcgcgctctgccccttgctgtcctctggggacctgggcagatgcggactttctccccagcagcccggccctgagcgccctggcctgggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgaga

SEQ ID NO: 184265 - DNA, 2358 bp, Homo sapiens
  Payload ID: 16288
  Gene Symbol: SLC43A1
  Gene Name: solute carrier family 43 (amino acid system L transporter), member 1
  Uniprot ID: O75387
  ENST ID: ENST00000528450
  CDS Start-End: 119-1798
gtcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgaga

SEQ ID NO: 184266 - DNA, 556 bp, Homo sapiens
  Payload ID: 16288
  Gene Symbol: SLC43A1
  Gene Name: solute carrier family 43 (amino acid system L transporter), member 1
  ENST ID: ENST00000525764
  CDS Start-End: 1-556
caccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgca

SEQ ID NO: 184267 - DNA, 8136 bp, Homo sapiens
  Payload ID: 16289
  Gene Symbol: SLC43A2
  Gene Name: solute carrier family 43 (amino acid system L transporter), member 2
  Uniprot ID: Q8N370
  ENST ID: ENST00000301335
  CDS Start-End: 90-1799
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagattctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccaactactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcggggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttgcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtgaagcttgcagtgagccgagattgtgccactgcactccagcctgggcgacagagcaagactccgtctcaaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgac

SEQ ID NO: 184268 - DNA, 1658 bp, Homo sapiens
  Payload ID: 16289
  Gene Symbol: SLC43A2
  Gene Name: solute carrier family 43 (amino acid system L transporter), member 2
  Uniprot ID: Q8N370
  ENST ID: ENST00000382147
  CDS Start-End: 257-1555
acctgtgagtgtggtggtgagtcaggaaacagctccggcttcctgcttggcagcaaagctggtccttcccctcctggggtccttcccctccgccagccctcgaggcccgcgctagggcgctctgctcagcgctcagccctcactccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggagctgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtct

SEQ ID NO: 184269 - DNA, 1658 bp, Homo sapiens; identical to SEQ ID NO: 184268
  Payload ID: 16289
  Gene Symbol: SLC43A2
  Gene Name: solute carrier family 43 (amino acid system L transporter), member 2
  Uniprot ID: Q8N370
  ENST ID: ENST00000412517
  CDS Start-End: 257-1555

SEQ ID NO: 184270 - DNA, 567 bp, Homo sapiens
  Payload ID: 16289
  Gene Symbol: SLC43A2
  Gene Name: solute carrier family 43 (amino acid system L transporter), member 2
  ENST ID: ENST00000576721
  CDS Start-End: 116-286
actccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggagagctgtggttcctgccagaggacacttccctcgttggctatgcccaggagcagcttgaccagaagattttccctgttatgaagtcataacacatatcataatactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttg

SEQ ID NO: 184271 - DNA, 915 bp, Homo sapiens
  Payload ID: 16289
  Gene Symbol: SLC43A2
  Gene Name: solute carrier family 43 (amino acid system L transporter), member 2
  ENST ID: ENST00000572801
  CDS Start-End: 94-282
gggcagaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatggggg

SEQ ID NO: 184272 - DNA, 3261 bp, Homo sapiens
  Payload ID: 16289
  Gene Symbol: SLC43A2
  Gene Name: solute carrier family 43 (amino acid system L transporter), member 2
  Uniprot ID: Q8N370
  ENST ID: ENST00000571650
  CDS Start-End: 308-2029
gtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagtgatggccacggttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaata

SEQ ID NO: 184273 - DNA, 623 bp, Homo sapiens
  Payload ID: 16289
  Gene Symbol: SLC43A2
  Gene Name: solute carrier family 43 (amino acid system L transporter), member 2
  ENST ID: ENST00000571376
  CDS Start-End: 38-367
agccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaac

SEQ ID NO: 184274 - DNA, 3261 bp, Homo sapiens; identical to SEQ ID NO: 184272
  Payload ID: 16289
  Gene Symbol: SLC43A2
  Gene Name: solute carrier family 43 (amino acid system L transporter), member 2
  Uniprot ID: Q8N370
  ENST ID: ENST00000612931
  CDS Start-End: 308-2029

SEQ ID NO: 184275 - DNA, 3011 bp, Homo sapiens
  Payload ID: 16289
  Gene Symbol: SLC43A2
  Gene Name: solute carrier family 43 (amino acid system L transporter), member 2
  Uniprot ID: Q8N370
  ENST ID: ENST00000613070
  CDS Start-End: 90-1811
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagtgatggccacggttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggt

SEQ ID NO: 184276 - DNA, 623 bp, Homo sapiens; identical to SEQ ID NO: 184273
  Payload ID: 16289
  Gene Symbol: SLC43A2
  Gene Name: solute carrier family 43 (amino acid system L transporter), member 2
  ENST ID: ENST00000631603
  CDS Start-End: 38-367

SEQ ID NO: 184277 - DNA, 567 bp, Homo sapiens; identical to SEQ ID NO: 184270
  Payload ID: 16289
  Gene Symbol: SLC43A2
  Gene Name: solute carrier family 43 (amino acid system L transporter), member 2
  ENST ID: ENST00000633255
  CDS Start-End: 116-286

SEQ ID NO: 184278 - DNA, 7430 bp, Homo sapiens
  Payload ID: 16289
  Gene Symbol: SLC43A2
  Gene Name: solute carrier family 43 (amino acid system L transporter), member 2
  Uniprot ID: Q8N370
  ENST ID: ENST00000634102
  CDS Start-End: 90-1799
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagattctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccaactactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcggggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttgcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtg

SEQ ID NO: 184279 - DNA, 915 bp, Homo sapiens; identical to SEQ ID NO: 184271
  Payload ID: 16289
  Gene Symbol: SLC43A2
  Gene Name: solute carrier family 43 (amino acid system L transporter), member 2
  ENST ID: ENST00000633994
  CDS Start-End: 94-282

SEQ ID NO: 184280 - DNA, 2595 bp, Homo sapiens
  Payload ID: 16290
  Gene Symbol: SLC43A3
  Gene Name: solute carrier family 43, member 3
  Uniprot ID: Q8NBI5
  ENST ID: ENST00000352187
  CDS Start-End: 284-1759
gctctgggagtgtgaaactgggagagacggttaagctggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 184281 - DNA, 2619 bp, Homo sapiens
  Payload ID: 16290
  Gene Symbol: SLC43A3
  Gene Name: solute carrier family 43, member 3
  Uniprot ID: Q8NBI5
  ENST ID: ENST00000395123
  CDS Start-End: 306-1781
gagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 184282 - DNA, 2617 bp, Homo sapiens
  Payload ID: 16290
  Gene Symbol: SLC43A3
  Gene Name: solute carrier family 43, member 3
  Uniprot ID: Q8NBI5
  ENST ID: ENST00000395124
  CDS Start-End: 306-1781
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 184283 - DNA, 494 bp, Homo sapiens
  Payload ID: 16290
  Gene Symbol: SLC43A3
  Gene Name: solute carrier family 43, member 3
  ENST ID: ENST00000529896
  CDS Start-End: 249-494
taggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagagg

SEQ ID NO: 184284 - DNA, 589 bp, Homo sapiens
  Payload ID: 16290
  Gene Symbol: SLC43A3
  Gene Name: solute carrier family 43, member 3
  ENST ID: ENST00000533245
  CDS Start-End: 261-589
gcgaatgcgaacctggcccgtgcggaaagggcgcggagagccccggcgcggagcaggcggcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccac

SEQ ID NO: 184285 - DNA, 573 bp, Homo sapiens
  Payload ID: 16290
  Gene Symbol: SLC43A3
  Gene Name: solute carrier family 43, member 3
  ENST ID: ENST00000530316
  CDS Start-End: 441-573
gcgaatgcgaacctggcccgtgcggaaagggcgcggagagccccggcgcggagcaggcggtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaagg

SEQ ID NO: 184286 - DNA, 862 bp, Homo sapiens
  Payload ID: 16290
  Gene Symbol: SLC43A3
  Gene Name: solute carrier family 43, member 3
  ENST ID: ENST00000525205
  CDS Start-End: 1-413
gcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacagtttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttag

SEQ ID NO: 184287 - DNA, 397 bp, Homo sapiens
  Payload ID: 16290
  Gene Symbol: SLC43A3
  Gene Name: solute carrier family 43, member 3
  ENST ID: ENST00000529748
  CDS Start-End: 332-397
gggaggctgaaaggcagcgaggagggagggaaagacaccgctggggttctagggggttctagagggagaagtttcaagagggagaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggc

SEQ ID NO: 184288 - DNA, 560 bp, Homo sapiens
  Payload ID: 16290
  Gene Symbol: SLC43A3
  Gene Name: solute carrier family 43, member 3
  ENST ID: ENST00000529494
  CDS Start-End: 203-560
gaatgcgaacctggcccgtgcggaaagggcgcggagagccccggcgcggagcaggcgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctg

SEQ ID NO: 184289 - DNA, 541 bp, Homo sapiens
  Payload ID: 16290
  Gene Symbol: SLC43A3
  Gene Name: solute carrier family 43, member 3
  ENST ID: ENST00000529113
  CDS Start-End: 162-541
ttgatctgggaagtgcctgggagggaggcaccagctcctgaggggtaattaggggcagccacatttcaactcagcttaagggacaagtttgcgaccgacaagctgtctgaggtggaggggagcccagcctgtgtgctcatttggcaggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttcttta

SEQ ID NO: 184290 - DNA, 506 bp, Homo sapiens
  Payload ID: 16290
  Gene Symbol: SLC43A3
  Gene Name: solute carrier family 43, member 3
  ENST ID: ENST00000532278
  CDS Start-End: 502-506
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccagtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggc

SEQ ID NO: 184291 - DNA, 1879 bp, Homo sapiens
  Payload ID: 16290
  Gene Symbol: SLC43A3
  Gene Name: solute carrier family 43, member 3
  Uniprot ID: Q8NBI5
  ENST ID: ENST00000533524
  CDS Start-End: 343-1857
gcgaatgcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcag

SEQ ID NO: 184292 - DNA, 539 bp, Homo sapiens
  Payload ID: 16290
  Gene Symbol: SLC43A3
  Gene Name: solute carrier family 43, member 3
  ENST ID: ENST00000524863
  CDS Start-End: 235-539
gcgaacctggcccgtgcggaaagggcgcggagagccccggcgcggagcaggcgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcct

SEQ ID NO: 184293 - DNA, 562 bp, Homo sapiens
  Payload ID: 16290
  Gene Symbol: SLC43A3
  Gene Name: solute carrier family 43, member 3
  ENST ID: ENST00000526621
  CDS Start-End: 372-562
gcaaaatgcacaaatagagtgtgtgtgtccctatgccctcatgtgctgtctgtgtgtcctctgggtgctgggtgtgacattttccctaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggct

SEQ ID NO: 184294 - DNA, 653 bp, Homo sapiens
  Payload ID: 16290
  Gene Symbol: SLC43A3
  Gene Name: solute carrier family 43, member 3
  ENST ID: ENST00000529112
  CDS Start-End: 210-653
gggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattggg

SEQ ID NO: 184295 - DNA, 587 bp, Homo sapiens
  Payload ID: 16290
  Gene Symbol: SLC43A3
  Gene Name: solute carrier family 43, member 3
  ENST ID: ENST00000532795
  CDS Start-End: 295-587
atgtgctgtctgtgtgtcctctgggtgctgggtgtgacattttccctaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccac

SEQ ID NO: 184296 - DNA, 581 bp, Homo sapiens
  Payload ID: 16290
  Gene Symbol: SLC43A3
  Gene Name: solute carrier family 43, member 3
  ENST ID: ENST00000533235
  CDS Start-End: 259-581
aaatagagtgtgtgtgtccctatgccctcatgtgctgtctgtgtgtcctctgggtgctgggtgtgacattttccctaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttcta

SEQ ID NO: 184297 - DNA, 648 bp, Homo sapiens
  Payload ID: 16290
  Gene Symbol: SLC43A3
  Gene Name: solute carrier family 43, member 3
  ENST ID: ENST00000528187
  CDS Start-End: 249-648
gcggaaagggcgcggagagccccggcgcggagcaggcgggggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcag

SEQ ID NO: 184298 - DNA, 571 bp, Homo sapiens
  Payload ID: 16290
  Gene Symbol: SLC43A3
  Gene Name: solute carrier family 43, member 3
  ENST ID: ENST00000533051
  CDS Start-End: 337-571
gcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtcct

SEQ ID NO: 184299 - DNA, 1434 bp, Homo sapiens
  Payload ID: 16290
  Gene Symbol: SLC43A3
  Gene Name: solute carrier family 43, member 3
  ENST ID: ENST00000530005
  CDS Start-End: 441-1434
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtg

SEQ ID NO: 184300 - DNA, 801 bp, Homo sapiens
  Payload ID: 16290
  Gene Symbol: SLC43A3
  Gene Name: solute carrier family 43, member 3
  ENST ID: ENST00000525474
  CDS Start-End: 295-801
acattttccctaggtgggcctgagcgagtaacagcattcaactaacttggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcc

SEQ ID NO: 184301 - DNA, 2207 bp, Homo sapiens
  Payload ID: 16290
  Gene Symbol: SLC43A3
  Gene Name: solute carrier family 43, member 3
  Uniprot ID: Q8NBI5
  ENST ID: ENST00000529554
  CDS Start-End: 346-1821
agtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttca

SEQ ID NO: 184302 - DNA, 10511 bp, Homo sapiens
  Payload ID: 16291
  Gene Symbol: SLC44A1
  Gene Name: solute carrier family 44 (choline transporter), member 1
  Uniprot ID: Q8WWI5
  ENST ID: ENST00000374720
  CDS Start-End: 248-2221
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 184303 - DNA, 9640 bp, Homo sapiens
  Payload ID: 16291
  Gene Symbol: SLC44A1
  Gene Name: solute carrier family 44 (choline transporter), member 1
  Uniprot ID: Q8WWI5
  ENST ID: ENST00000374723
  CDS Start-End: 248-2206
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 184304 - DNA, 3088 bp, Homo sapiens
  Payload ID: 16291
  Gene Symbol: SLC44A1
  Gene Name: solute carrier family 44 (choline transporter), member 1
  Uniprot ID: Q8WWI5
  ENST ID: ENST00000374724
  CDS Start-End: 248-2212
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgatagaaatctgtcttgcagcactgtcttcacatttaatgttgctttctcttctagtctcgggtatgtttaaatgattcccttttctcactctagcgccaatactggcctgaaggctagatccccagcgaaattcttgttcaggctgggtctgtcgactttgactctgctatttatagagccaatgtgggttaataactactatttattgagtgcccgttccatgccaagcattaggctgggtgctttacataagtttaatcctcacaatagccctgtaaggttgcacctattatctccactttgaccacgaagaaacggagactcagagagtttgtatcctatgtgtaagatcacacagttgtcagagtcaggattcaaatctagttctaactccaaagctctccacactaacattgttttgcttattattgctccaaagataattaccccaacaccttatcaatgctatacttcctctcataatggcagtgtaggtatgtgggaagtgtctgagatggaggaccagggagtctttagaggcgcaaaagaatcacagaattatcttctaaaaaaaaacacaatattctttgagatcaggagttgataaaatatggcccccagctatttttgtaaataaaggtttattgggaacacagccacacccaatccttca

SEQ ID NO: 184305 - DNA, 10433 bp, Homo sapiens
  Payload ID: 16291
  Gene Symbol: SLC44A1
  Gene Name: solute carrier family 44 (choline transporter), member 1
  Uniprot ID: Q8WWI5
  ENST ID: ENST00000470972
  CDS Start-End: 248-2221
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 184306 - DNA, 3671 bp, Homo sapiens
  Payload ID: 16292
  Gene Symbol: SLC44A2
  Gene Name: solute carrier family 44 (choline transporter), member 2
  Uniprot ID: Q8IWA5
  ENST ID: ENST00000335757
  CDS Start-End: 377-2497
ctcagtttccacacctgcaaaacgaagccacggaaacgccctttcagggtggccaggggttctaggcggcatcgcccggtggcagggtgttcccagggtgaagccgcagggttcccgggtgggggcggggaaggctaaatgcggccggccggtgagtggcgggagcagctgcagccccgcccgcgccctcccgggtcccttagtctgggcagctgcccagctcgggccggtctgaccggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagaggggggggtctcccgtttcctgtgcctgcaccagccctgcccccattgcgtctgcacacccctgcgtgtaactgcattccaaccactaataaagtgcctattgtacaggtcca

SEQ ID NO: 184307 - DNA, 3301 bp, Homo sapiens
  Payload ID: 16292
  Gene Symbol: SLC44A2
  Gene Name: solute carrier family 44 (choline transporter), member 2
  Uniprot ID: Q8IWA5
  ENST ID: ENST00000407327
  CDS Start-End: 22-2136
gctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagaggggggggtctcccgtttcctgtgcctgcaccagccctgcccccattgcgtctgcacacccctgcgtgtaactgcattccaaccactaataaagtgcctattgt

SEQ ID NO: 184308 - DNA, 574 bp, Homo sapiens
  Payload ID: 16292
  Gene Symbol: SLC44A2
  Gene Name: solute carrier family 44 (choline transporter), member 2
  ENST ID: ENST00000590857
  CDS Start-End: 543-574
gtgctgggaggagccgccgccagtcgcgcggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgg

SEQ ID NO: 184309 - DNA, 602 bp, Homo sapiens
  Payload ID: 16292
  Gene Symbol: SLC44A2
  Gene Name: solute carrier family 44 (choline transporter), member 2
  ENST ID: ENST00000591194
  CDS Start-End: 1-374
ctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttc

SEQ ID NO: 184310 - DNA, 789 bp, Homo sapiens
  Payload ID: 16292
  Gene Symbol: SLC44A2
  Gene Name: solute carrier family 44 (choline transporter), member 2
  ENST ID: ENST00000592293
  CDS Start-End: 41-169
agagagcgcgggcggccgccggggctggtcgcctgcagggatgggggacgagcggccccactactacgggaaacacggaacgccacagaagtatgatcccactttcaaaggacccatttacaatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacg

SEQ ID NO: 184311 - DNA, 3784 bp, Homo sapiens
  Payload ID: 16292
  Gene Symbol: SLC44A2
  Gene Name: solute carrier family 44 (choline transporter), member 2
  Uniprot ID: Q8IWA5
  ENST ID: ENST00000586078
  CDS Start-End: 110-2245
gggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgggcagaagccgaggagtagagagtgagggagactggcgtgggggccaggtttcctccatgtagactgggggtgcatgaagcgggggggttcctggcctgcgagtgtggggatcctgtgtgtccctcggagcccactacagtctgcccctctctggtcccagtgtgtctgctttctaaccctctgaggcttctctgtgaccctcatccacctaccctgtccttgaggcccctgcccgtgggctcccctcatgcctcctgctctgggacctctctccacagtggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagaggggggggtctcccgtttcctgtgcctgcaccagccctgcccccattgcgtctgcacacccctgcgtgtaactgcattccaaccactaataaagtgcctattgtacaggtc

SEQ ID NO: 184312 - DNA, 553 bp, Homo sapiens
  Payload ID: 16292
  Gene Symbol: SLC44A2
  Gene Name: solute carrier family 44 (choline transporter), member 2
  ENST ID: ENST00000588688
  CDS Start-End: 115-553
gtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaa

SEQ ID NO: 184313 - DNA, 589 bp, Homo sapiens
  Payload ID: 16292
  Gene Symbol: SLC44A2
  Gene Name: solute carrier family 44 (choline transporter), member 2
  ENST ID: ENST00000588409
  CDS Start-End: 41-328
agagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgc

SEQ ID NO: 184314 - DNA, 586 bp, Homo sapiens
  Payload ID: 16292
  Gene Symbol: SLC44A2
  Gene Name: solute carrier family 44 (choline transporter), member 2
  ENST ID: ENST00000590382
  CDS Start-End: 75-586
agcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttga

SEQ ID NO: 184315 - DNA, 1300 bp, Homo sapiens
  Payload ID: 16292
  Gene Symbol: SLC44A2
  Gene Name: solute carrier family 44 (choline transporter), member 2
  ENST ID: ENST00000586549
  CDS Start-End: 1-445
catgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgggcagaagccgaggagtagagatggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggct

SEQ ID NO: 184316 - DNA, 2388 bp, Homo sapiens
  Payload ID: 16293
  Gene Symbol: SLC44A3
  Gene Name: solute carrier family 44, member 3
  Uniprot ID: Q8N4M1
  ENST ID: ENST00000271227
  CDS Start-End: 103-2064
cagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcattgtctttgtcattattgtttgaccaggtaacaatactggaactatattagtttacctttttttgtacaaattaggacagaaaaactcttctaaaaccatgtttatatgcatcaacttacaaagtacactatgtaagaactgaggtaagtttgtaagtgcacaactaataaataaacctttttaagataagga

SEQ ID NO: 184317 - DNA, 2094 bp, Homo sapiens
  Payload ID: 16293
  Gene Symbol: SLC44A3
  Gene Name: solute carrier family 44, member 3
  Uniprot ID: Q8N4M1
  ENST ID: ENST00000446120
  CDS Start-End: 111-1964
cccagccccagccccagccccggccccggccccggctcgcgggcgctgcgtctccgcgtacaggaggcggcggcggctcccagtcaccggcccccgccggcgagcgcacgatgcactgcctgggcgccgagtacctggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 184318 - DNA, 684 bp, Homo sapiens
  Payload ID: 16293
  Gene Symbol: SLC44A3
  Gene Name: solute carrier family 44, member 3
  ENST ID: ENST00000422520
  CDS Start-End: 196-684
ctccagtgctggggcggaggcgggggagacgcgggccgcggggcgcaaacttggggtcgtcctcaggtgcacctccaggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcggga

SEQ ID NO: 184319 - DNA, 2045 bp, Homo sapiens
  Payload ID: 16293
  Gene Symbol: SLC44A3
  Gene Name: solute carrier family 44, member 3
  Uniprot ID: Q8N4M1
  ENST ID: ENST00000529450
  CDS Start-End: 52-1914
acaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaagggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctca

SEQ ID NO: 184320 - DNA, 2061 bp, Homo sapiens
  Payload ID: 16293
  Gene Symbol: SLC44A3
  Gene Name: solute carrier family 44, member 3
  Uniprot ID: Q8N4M1
  ENST ID: ENST00000467909
  CDS Start-End: 113-1930
ctggcggggaggaacctggaccctgctccagtgctggggcggaggcgggggagacgcgggccgcggggcgcaaacttggggtcgtcctcaggtgcacctccaggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctca

SEQ ID NO: 184321 - DNA, 460 bp, Homo sapiens
  Payload ID: 16293
  Gene Symbol: SLC44A3
  Gene Name: solute carrier family 44, member 3
  ENST ID: ENST00000532670
  CDS Start-End: 1-330
cagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaagagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 184322 - DNA, 1943 bp, Homo sapiens
  Payload ID: 16293
  Gene Symbol: SLC44A3
  Gene Name: solute carrier family 44, member 3
  Uniprot ID: Q8N4M1
  ENST ID: ENST00000527077
  CDS Start-End: 56-1813
gcgtacaggaggcggcggcggctcccagtcaccggcccccgccggcgagcgcacgatgcactgcctgggcgccgagtacctggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaagggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 184323 - DNA, 2067 bp, Homo sapiens
  Payload ID: 16293
  Gene Symbol: SLC44A3
  Gene Name: solute carrier family 44, member 3
  ENST ID: ENST00000475883
  CDS Start-End: 1-251
tgtttatcatgggctactcggtggtggctggagccgcgggaagactcctctttggctatgacagctttggcaacatgtgtggcaagaagaactcccccgtggaaggggcccctctttcagggcaggacatgaccctaaaaaaagccacttacaaagaagacaggaggaggaagggcgacttagatgcccatgtgctcccatttcacattgtgttcataatgcagtgtcaacaaacagtcattcctggttgaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctca

SEQ ID NO: 184324 - DNA, 1912 bp, Homo sapiens
  Payload ID: 16293
  Gene Symbol: SLC44A3
  Gene Name: solute carrier family 44, member 3
  ENST ID: ENST00000532427
  CDS Start-End: 84-1805
agtgctggggcggaggcgggggagacgcgggccgcggggcgcaaacttggggtcgtcctcaggtgcacctccaggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaagggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaaga

SEQ ID NO: 184325 - DNA, 2589 bp, Homo sapiens
  Payload ID: 16294
  Gene Symbol: SLC44A4
  Gene Name: solute carrier family 44, member 4
  Uniprot ID: Q53GD3
  ENST ID: ENST00000229729
  CDS Start-End: 22-2154
aatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaa

SEQ ID NO: 184326 - DNA, 2505 bp, Homo sapiens
  Payload ID: 16294
  Gene Symbol: SLC44A4
  Gene Name: solute carrier family 44, member 4
  Uniprot ID: Q53GD3
  ENST ID: ENST00000375562
  CDS Start-End: 67-2073
agggcggggcgggcagcaggtgagacgccaggtctccagggctccaatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccagacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 184327 - DNA, 2589 bp, Homo sapiens; identical to SEQ ID NO: 184325
  Payload ID: 16294
  Gene Symbol: SLC44A4
  Gene Name: solute carrier family 44, member 4
  Uniprot ID: Q53GD3
  ENST ID: ENST00000383379
  CDS Start-End: 22-2154

SEQ ID NO: 184328 - DNA, 2589 bp, Homo sapiens
  Payload ID: 16294
  Gene Symbol: SLC44A4
  Gene Name: solute carrier family 44, member 4
  Uniprot ID: Q53GD3
  ENST ID: ENST00000417894
  CDS Start-End: 22-2154
aatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaa

SEQ ID NO: 184329 - DNA, 1233 bp, Homo sapiens
  Payload ID: 16294
  Gene Symbol: SLC44A4
  Gene Name: solute carrier family 44, member 4
  ENST ID: ENST00000458130
  CDS Start-End: 1-1233
agcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgtggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagag

SEQ ID NO: 184330 - DNA, 2589 bp, Homo sapiens; identical to SEQ ID NO: 184325
  Payload ID: 16294
  Gene Symbol: SLC44A4
  Gene Name: solute carrier family 44, member 4
  Uniprot ID: Q53GD3
  ENST ID: ENST00000453831
  CDS Start-End: 22-2154

SEQ ID NO: 184331 - DNA, 1233 bp, Homo sapiens; identical to SEQ ID NO: 184329
  Payload ID: 16294
  Gene Symbol: SLC44A4
  Gene Name: solute carrier family 44, member 4
  ENST ID: ENST00000431710
  CDS Start-End: 1-1233

SEQ ID NO: 184332 - DNA, 2589 bp, Homo sapiens; identical to SEQ ID NO: 184328
  Payload ID: 16294
  Gene Symbol: SLC44A4
  Gene Name: solute carrier family 44, member 4
  Uniprot ID: Q53GD3
  ENST ID: ENST00000442152
  CDS Start-End: 22-2154

SEQ ID NO: 184333 - DNA, 1233 bp, Homo sapiens; identical to SEQ ID NO: 184329
  Payload ID: 16294
  Gene Symbol: SLC44A4
  Gene Name: solute carrier family 44, member 4
  ENST ID: ENST00000414427
  CDS Start-End: 1-1233

SEQ ID NO: 184334 - DNA, 2589 bp, Homo sapiens; identical to SEQ ID NO: 184325
  Payload ID: 16294
  Gene Symbol: SLC44A4
  Gene Name: solute carrier family 44, member 4
  Uniprot ID: Q53GD3
  ENST ID: ENST00000425238
  CDS Start-End: 22-2154

SEQ ID NO: 184335 - DNA, 1233 bp, Homo sapiens
  Payload ID: 16294
  Gene Symbol: SLC44A4
  Gene Name: solute carrier family 44, member 4
  ENST ID: ENST00000450933
  CDS Start-End: 1-1233
agcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgtggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagag

SEQ ID NO: 184336 - DNA, 1233 bp, Homo sapiens; identical to SEQ ID NO: 184329
  Payload ID: 16294
  Gene Symbol: SLC44A4
  Gene Name: solute carrier family 44, member 4
  ENST ID: ENST00000433046
  CDS Start-End: 1-1233

SEQ ID NO: 184337 - DNA, 2589 bp, Homo sapiens; identical to SEQ ID NO: 184328
  Payload ID: 16294
  Gene Symbol: SLC44A4
  Gene Name: solute carrier family 44, member 4
  Uniprot ID: Q53GD3
  ENST ID: ENST00000415517
  CDS Start-End: 22-2154

SEQ ID NO: 184338 - DNA, 1233 bp, Homo sapiens; identical to SEQ ID NO: 184335
  Payload ID: 16294
  Gene Symbol: SLC44A4
  Gene Name: solute carrier family 44, member 4
  ENST ID: ENST00000441920
  CDS Start-End: 1-1233

SEQ ID NO: 184339 - DNA, 1233 bp, Homo sapiens; identical to SEQ ID NO: 184335
  Payload ID: 16294
  Gene Symbol: SLC44A4
  Gene Name: solute carrier family 44, member 4
  ENST ID: ENST00000414684
  CDS Start-End: 1-1233

SEQ ID NO: 184340 - DNA, 2634 bp, Homo sapiens
  Payload ID: 16294
  Gene Symbol: SLC44A4
  Gene Name: solute carrier family 44, member 4
  Uniprot ID: Q53GD3
  ENST ID: ENST00000544672
  CDS Start-End: 298-2202
actgaggtcccaccagagtgaggatgtacagggccgcttccctccccaggccctgctggggttgacacctttgtctccagtttctttccccatagccttgaaccagaggggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 184341 - DNA, 2634 bp, Homo sapiens
  Payload ID: 16294
  Gene Symbol: SLC44A4
  Gene Name: solute carrier family 44, member 4
  ENST ID: ENST00000547288
  CDS Start-End: 298-2202
actgaggtcccaccagagtgaggatgtacagggccgcttccctccccaggccctgctggggttgacacctttgtctccagtttctttccccatagccttgaaccagaggggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 184342 - DNA, 2634 bp, Homo sapiens; identical to SEQ ID NO: 184340
  Payload ID: 16294
  Gene Symbol: SLC44A4
  Gene Name: solute carrier family 44, member 4
  Uniprot ID: Q53GD3
  ENST ID: ENST00000548188
  CDS Start-End: 298-2202

SEQ ID NO: 184343 - DNA, 2505 bp, Homo sapiens
  Payload ID: 16294
  Gene Symbol: SLC44A4
  Gene Name: solute carrier family 44, member 4
  Uniprot ID: Q53GD3
  ENST ID: ENST00000553121
  CDS Start-End: 67-2073
agggcggggcgggcagcaggtgagacgccaggtctccagggctccaatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccagacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 184344 - DNA, 2505 bp, Homo sapiens; identical to SEQ ID NO: 184326
  Payload ID: 16294
  Gene Symbol: SLC44A4
  Gene Name: solute carrier family 44, member 4
  Uniprot ID: Q53GD3
  ENST ID: ENST00000551168
  CDS Start-End: 67-2073

SEQ ID NO: 184345 - DNA, 2634 bp, Homo sapiens; identical to SEQ ID NO: 184341
  Payload ID: 16294
  Gene Symbol: SLC44A4
  Gene Name: solute carrier family 44, member 4
  ENST ID: ENST00000553147
  CDS Start-End: 298-2202

SEQ ID NO: 184346 - DNA, 2505 bp, Homo sapiens; identical to SEQ ID NO: 184343
  Payload ID: 16294
  Gene Symbol: SLC44A4
  Gene Name: solute carrier family 44, member 4
  Uniprot ID: Q53GD3
  ENST ID: ENST00000550401
  CDS Start-End: 67-2073

SEQ ID NO: 184347 - DNA, 2634 bp, Homo sapiens; identical to SEQ ID NO: 184340
  Payload ID: 16294
  Gene Symbol: SLC44A4
  Gene Name: solute carrier family 44, member 4
  Uniprot ID: Q53GD3
  ENST ID: ENST00000546461
  CDS Start-End: 298-2202

SEQ ID NO: 184348 - DNA, 2634 bp, Homo sapiens; identical to SEQ ID NO: 184340
  Payload ID: 16294
  Gene Symbol: SLC44A4
  Gene Name: solute carrier family 44, member 4
  Uniprot ID: Q53GD3
  ENST ID: ENST00000547684
  CDS Start-End: 298-2202

SEQ ID NO: 184349 - DNA, 2505 bp, Homo sapiens; identical to SEQ ID NO: 184343
  Payload ID: 16294
  Gene Symbol: SLC44A4
  Gene Name: solute carrier family 44, member 4
  Uniprot ID: Q53GD3
  ENST ID: ENST00000547493
  CDS Start-End: 67-2073

SEQ ID NO: 184350 - DNA, 2505 bp, Homo sapiens; identical to SEQ ID NO: 184326
  Payload ID: 16294
  Gene Symbol: SLC44A4
  Gene Name: solute carrier family 44, member 4
  Uniprot ID: Q53GD3
  ENST ID: ENST00000549677
  CDS Start-End: 67-2073

SEQ ID NO: 184351 - DNA, 2505 bp, Homo sapiens; identical to SEQ ID NO: 184326
  Payload ID: 16294
  Gene Symbol: SLC44A4
  Gene Name: solute carrier family 44, member 4
  Uniprot ID: Q53GD3
  ENST ID: ENST00000549663
  CDS Start-End: 67-2073

SEQ ID NO: 184352 - DNA, 2634 bp, Homo sapiens; identical to SEQ ID NO: 184341
  Payload ID: 16294
  Gene Symbol: SLC44A4
  Gene Name: solute carrier family 44, member 4
  ENST ID: ENST00000550821
  CDS Start-End: 298-2202

SEQ ID NO: 184353 - DNA, 4406 bp, Homo sapiens
  Payload ID: 16295
  Gene Symbol: SLC44A5
  Gene Name: solute carrier family 44, member 5
  ENST ID: ENST00000370855
  CDS Start-End: 115-2274
aggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttg

SEQ ID NO: 184354 - DNA, 3896 bp, Homo sapiens
  Payload ID: 16295
  Gene Symbol: SLC44A5
  Gene Name: solute carrier family 44, member 5
  Uniprot ID: Q8NCS7
  ENST ID: ENST00000370859
  CDS Start-End: 147-2300
acagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaat

SEQ ID NO: 184355 - DNA, 2401 bp, Homo sapiens
  Payload ID: 16296
  Gene Symbol: SLC45A1
  Gene Name: solute carrier family 45, member 1
  Uniprot ID: Q9Y2W3
  ENST ID: ENST00000289877
  CDS Start-End: 1-2247
atgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagccta

SEQ ID NO: 184356 - DNA, 2784 bp, Homo sapiens
  Payload ID: 16296
  Gene Symbol: SLC45A1
  Gene Name: solute carrier family 45, member 1
  ENST ID: ENST00000471889
  CDS Start-End: 284-2632
tttatacatgaagacacgaaaatgtatttatttcttttaaaatcagaagaaaacggtgagaactgtgaggccggggggacgttttcctccgggatcctggcagatcctgcagaccgcgccgtcgtgcgcgaagcaccgggacgggcctcccgcgggaagggcccaggaggacaccgggctcccctcccgcccgcggggccccagacgcggcgccgctttaaggctccgggccccgcgcggatgcggaggctgcggccgtgacgtcagcgccccgccccgggtgatgctgcagcagccgggaccgcggccgggcaggcagcagcccagcggggacagggatgcctgccgtctccacccacagggacgcccaccagccctccccacgatgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagcc

SEQ ID NO: 184357 - DNA, 1772 bp, Homo sapiens
  Payload ID: 16297
  Gene Symbol: SLC45A2
  Gene Name: solute carrier family 45, member 2
  Uniprot ID: Q9UMX9
  ENST ID: ENST00000296589
  CDS Start-End: 148-1740
ggcaggaaagaatttgagcccctcccccagcctgaccatctctgttggttgctcggccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaacctcaga

SEQ ID NO: 184358 - DNA, 2723 bp, Homo sapiens
  Payload ID: 16297
  Gene Symbol: SLC45A2
  Gene Name: solute carrier family 45, member 2
  Uniprot ID: Q9UMX9
  ENST ID: ENST00000382102
  CDS Start-End: 59-1441
gaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggaggtgtgctgtcattgaacctctgccttgggtaacatccagactcatctgaaggctggggaggatttggtagcaatgtgtagagcagagctggaaaataagggttcttgaaacagcaacagtcaaatgcccaaccaactgcaaccatgatctggtacaggcatgctcaccagcccagcccagcccagctgtcctgtcctccttattctcaactcctgctcacttagggagctgtagggcaagaagtgttactcccatttttctaattagaaaaaggcttggtgaggctgagaaaccagcccacaattacacaaagacaaaaaaagggggacccaggtcttctgtaaccacctcataggtctccctggtgccacctgcagcatttctagataccgacaataagggtctccctatccccaactttcagaggtacatagtggaatttcttggcattatttgctgagggtaggaaagtcctaggcaatggagtccagattttagtaagtcagaccccatgtgtgagaaggaaagctggaatcatgggtggtaatccccactttgctgccctgagcgggacctgtgccatttaaaccttggaacgcaactagtgaacaagcgcctatgcagtgcttataacagagttggtgtttccactctaaaattaccacctcttcttatcaaaatttgcaactttcttcctgtgaaaataggcttatagttccttaactggagcaatgatataaaagctacagagataactccaagtttaatccagctcagcatgaaactgcaaaaacactgaacatataaccatcagactataattctggccatgtttttcatcatttgatctggcagcagggcagaggtgcaccaggagtaaaaacctttcaaaaaagaggtgtggctttcctcatcccctggcaaacattgtcaccaaggtgggatgttgctgctaatgggagagtcatcataaaaaactgtccctacaaggagagtgttacatggtgttgggggaagaaaacctacgcttcaggctcagagaaacctggattcaaatcctgcctctctcacttggaagctgtgttacactggggatgttatttacttgtttattagttagcacttagaatgagttcatttttaggtgagataatatattcacaatgatacacaaaagtgcacactgtgtgctccctttaccatttactatctccctccagccccaacgtgttaccactcttactagttttttgttaatctttccggcatttttaaataaaaaccaagcaaatgtaaa

SEQ ID NO: 184359 - DNA, 1040 bp, Homo sapiens
  Payload ID: 16297
  Gene Symbol: SLC45A2
  Gene Name: solute carrier family 45, member 2
  ENST ID: ENST00000509381
  CDS Start-End: 62-793
acagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttgtaagtctttctctctcctaaggatgtcttctaaaagtttctggtctagcacaacttggatttgatatttctatgtgtatttcctactgtttaaaataccagattcttaataaatctatggacgtcaggaaaaactatcaccttaaaaa

SEQ ID NO: 184360 - DNA, 740 bp, Homo sapiens
  Payload ID: 16297
  Gene Symbol: SLC45A2
  Gene Name: solute carrier family 45, member 2
  ENST ID: ENST00000510600
  CDS Start-End: 3-740
gcatggctctgtacctcaatggggctactgttgtagcaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtc

SEQ ID NO: 184361 - DNA, 1777 bp, Homo sapiens
  Payload ID: 16297
  Gene Symbol: SLC45A2
  Gene Name: solute carrier family 45, member 2
  ENST ID: ENST00000626332
  CDS Start-End: 1-495
actcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggaggtgtgctgtcattgaacctctgccttgggtaacatccagactcatctgaaggctggggaggatttggtagcaatgtgtagagcagagctggaaaataagggttcttgaaacagcaacagtcaaatgcccaaccaactgcaaccatgatctggtacaggcatgctcaccagcccagcccagcccagctgtcctgtcctccttattctcaactcctgctcacttagggagctgtagggcaagaagtgttactcccatttttctaattagaaaaaggcttggtgaggctgagaaaccagcccacaattacacaaagacaaaaaaagggggacccaggtcttctgtaaccacctcataggtctccctggtgccacctgcagcatttctagataccgacaataagggtctccctatccccaactttcagaggtacatagtggaatttcttggcattatttgctgagggtaggaaagtcctaggcaatggagtccagattttagtaagtcagaccccatgtgtgagaaggaaagctggaatcatgggtggtaatccccactttgctgccctgagcgggacctgtgccatttaaaccttggaacgcaactagtgaacaagcgcctatgcagtgcttataacagagttggtgtttccactctaaaattaccacctcttcttatcaaaatttgcaactttcttcctgtgaaaataggcttatagttccttaactggagcaatgatataaaagctacagagataactccaagtttaatccagctcagcatgaaactgcaaaaacactgaacatataaccatcagactataattctggccatgtttttcatcatttgatctggcagcagggcagaggtgcaccaggagtaaaaacctttcaaaaaagaggtgtggctttcctcatcccctggcaaacattgtcaccaaggtgggatgttgctgctaatgggagagtcatcataaaaaactgtccctacaaggagagtgttacatggtgttgggggaagaaaacctacgcttcaggctcagagaaacctggattcaaatcctgcctctctcacttggaagctgtgttacactggggatgttatttacttgtttattagttagcacttagaatgagttcatttttaggtgagataatatattcacaatgatacacaaaagtgcacactgtgtgctccctttaccatttactatctccctccagccccaacgtgttaccactcttactagttttttgttaatctttccggcatttttaaataaaaaccaagcaaatgtaaa

SEQ ID NO: 184362 - DNA, 417 bp, Homo sapiens
  Payload ID: 16297
  Gene Symbol: SLC45A2
  Gene Name: solute carrier family 45, member 2
  ENST ID: ENST00000631273
  CDS Start-End: 1-170
actcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttgtaagtctttctctctcctaaggatgtcttctaaaagtttctggtctagcacaacttggatttgatatttctatgtgtatttcctactgtttaaaataccagattcttaataaatctatggacgtcaggaaaaactatcaccttaaaaa

SEQ ID NO: 184363 - DNA, 375 bp, Homo sapiens
  Payload ID: 16297
  Gene Symbol: SLC45A2
  Gene Name: solute carrier family 45, member 2
  ENST ID: ENST00000626082
  CDS Start-End: 1-375
actcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtc

SEQ ID NO: 184364 - DNA, 737 bp, Homo sapiens
  Payload ID: 16297
  Gene Symbol: SLC45A2
  Gene Name: solute carrier family 45, member 2
  ENST ID: ENST00000631255
  CDS Start-End: 1-705
actcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaacctcaga

SEQ ID NO: 184365 - DNA, 3341 bp, Homo sapiens
  Payload ID: 16298
  Gene Symbol: SLC45A3
  Gene Name: solute carrier family 45, member 3
  Uniprot ID: Q96JT2
  ENST ID: ENST00000367145
  CDS Start-End: 297-1958
aaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 184366 - DNA, 3546 bp, Homo sapiens
  Payload ID: 16299
  Gene Symbol: SLC45A4
  Gene Name: solute carrier family 45, member 4
  Uniprot ID: Q5BKX6
  ENST ID: ENST00000024061
  CDS Start-End: 309-2705
tgatagggcagagaggagcccatgctccagctgcggggagtgcctgcccgaggagctggccagtgaagacaggtgcctgccagtgaagacaggtgcccacaagctggacacagggtcggccctgagacaggacagcagctgcggaatgttcccgctggctttctggagcgccagcgtcctgcttgggtctggccaggggcctctagccaggctgttgaggcgcccctccttgttgaagaggagaaacagtggccccctgggagttgctgggaggtgcctggcacagggcggcagggacagcatcatctatggggaaagcaagcccagcctcagggctgtcccgtccaaagacccttgtgagtccactgaggtcaaatcaatggagtcttcagaaaggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagaacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaa

SEQ ID NO: 184367 - DNA, 3470 bp, Homo sapiens
  Payload ID: 16299
  Gene Symbol: SLC45A4
  Gene Name: solute carrier family 45, member 4
  ENST ID: ENST00000517878
  CDS Start-End: 1-2427
atgaaaatggctccgcagaatgccgacccggaatctatgcaagttcaagagttatccgtgcccctgccggacccgcagaaagccggaggcgcagaggccgagaactgcgagaccatcagcgaggggtccatagaccgaatccccatgcgcctgtgggtgatgcacggggcggtgatgtttggcagggagttctgttacgccatggaaaccgctctggtcacaccaatactgttgcagattggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtgacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtag

SEQ ID NO: 184368 - DNA, 835 bp, Homo sapiens
  Payload ID: 16299
  Gene Symbol: SLC45A4
  Gene Name: solute carrier family 45, member 4
  ENST ID: ENST00000520137
  CDS Start-End: 549-835
gtctccgcgcgccggccgcagcctcgcagcgctctctccgcgcccgcgtcgctgactgaccgcccggccggccggccgagggagcagcccccgcccggacccgcagccgcctcccgaccccggtgcgcccggggctccgcgcccccgtagcccctgcccggcccggcccggccgccccgccgcccccgcggccccggccggaggagacaggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtc

SEQ ID NO: 184369 - DNA, 7483 bp, Homo sapiens
  Payload ID: 16299
  Gene Symbol: SLC45A4
  Gene Name: solute carrier family 45, member 4
  Uniprot ID: Q5BKX6
  ENST ID: ENST00000519067
  CDS Start-End: 305-2458
agggcagagaggagcccatgctccagctgcggggagtgcctgcccgaggagctggccagtgaagacaggtgcctgccagtgaagacaggtgcccacaagctggacacagggtcggccctgagacaggacagcagctgcggaatgttcccgctggctttctggagcgccagcgtcctgcttgggtctggccaggggcctctagccaggctgttgaggcgcccctccttgttgaagaggagaaacagtggccccctgggagttgctgggaggtgcctggcacagggcggcagggacagcatcatctatggggaaagcaagcccagcctcagggctgtcccgtccaaagacccttgtgagtccactgaggtcaaatcaatggagtcttcagaaaggccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcattgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtggtctgagccgcactcccgtttacacacattccagtgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatga

SEQ ID NO: 184370 - DNA, 542 bp, Homo sapiens
  Payload ID: 16299
  Gene Symbol: SLC45A4
  Gene Name: solute carrier family 45, member 4
  ENST ID: ENST00000519986
  CDS Start-End: 237-542
ctgagaggctttctgatggaagggcggggacttcaggagcggccctcccttgttgagatggggtgctctgacagcacctttaactttaaagacctccagggcccagccctgacagccacagtgggtcttatttgagtcggtgatgcagaaacagaggcctgtgcttcttcagcttctgggaaacctacttccaagagtctactcaccgggccggctgtgttgtggaaaatagtctaatgcggcctctgacatgtaattcatttaccgagagccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccattggcatcgtgctcacggtgctgggagtggtggtcctggacttcagc

SEQ ID NO: 184371 - DNA, 844 bp, Homo sapiens
  Payload ID: 16300
  Gene Symbol: SLC46A1
  Gene Name: solute carrier family 46 (folate transporter), member 1
  ENST ID: ENST00000581516
  CDS Start-End: 747-844
gatcctagggcaggagtggagcaagtgacagcttgttttttattttatttttattttatattttttgagacagggtcttgctctgtcacccaggctggagtgcagtggtgcgatctcagcccactgcaacctctgcctcctgggctcaattgatcctcccacctcagccacccgagtacctgggactacaggtatctgctactacgcctggctaatttttgtgtattttttgtagagacagggttttaccatgttgcccagattggtctcgaactcctgggttcaagcgatccatgcgcctcagcctccaaaagtgctgggattacaggtgtgagccaccactcccagacgtgacagcctgttaatagcaataatagcactttgaatataccagacactgcttttccacaactttttgagacatgttttgttagcaactccattttacagatgaaaaaacagaggctcagggtgcgcagaacatcagcagcatcaggagtcatgtgctcttccagctctgccttgagtacccgatgacctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttg

SEQ ID NO: 184372 - DNA, 574 bp, Homo sapiens
  Payload ID: 16300
  Gene Symbol: SLC46A1
  Gene Name: solute carrier family 46 (folate transporter), member 1
  ENST ID: ENST00000582735
  CDS Start-End: 1-373
actaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggaga

SEQ ID NO: 184373 - DNA, 1030 bp, Homo sapiens
  Payload ID: 16300
  Gene Symbol: SLC46A1
  Gene Name: solute carrier family 46 (folate transporter), member 1
  ENST ID: ENST00000584995
  CDS Start-End: 280-1030
gttacagcgcagaacatcagcagcatcaggagtcatgtgctcttccagctctgccttgagtacccgatgacctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcc

SEQ ID NO: 184374 - DNA, 564 bp, Homo sapiens
  Payload ID: 16300
  Gene Symbol: SLC46A1
  Gene Name: solute carrier family 46 (folate transporter), member 1
  ENST ID: ENST00000584426
  CDS Start-End: 180-564
gtcatgtgctcttccagctctgccttgagtacccgatgacctcgtttcctcagcggtagatagcgatggttaatattggctagcctgtagagttatcgggagaccaacgcacaaaaagggtttaataccgtgcccagcacatagaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttgg

SEQ ID NO: 184375 - DNA, 6376 bp, Homo sapiens
  Payload ID: 16300
  Gene Symbol: SLC46A1
  Gene Name: solute carrier family 46 (folate transporter), member 1
  Uniprot ID: Q96NT5
  ENST ID: ENST00000612814
  CDS Start-End: 97-1476
acagcgcaagccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactgaaacaaaccttctggtgccttgggctttggggccctctgttttcctgctcccagtctgcctgccatacgttagacaacagaagctgctgggctgggcaggagccctgagctgcctggtggattggtaccaagtggggccagccagggcttctactgactcgctgtgcaaccttgagcaagccccactaggaacggctagatcagcaatgccccaaattgttgaatcgtggtgatcacatttggatggacaagttaggaaacttagctgattctctgagatacttcccacttcctcatacattctacaatgagatgcctctcttcatgggcctggggaaaggatgaatgagtgtggctggacttttgacctttaatgtccctgagcagttcttggcccttggggagaagtagggggaggatctggctgactcagccccaaccgaggggtagcagctgcagcccagccaagcagaacaccctggccctacagacctgtgtctgagcaggctttggaggaaaggccacttctgagtcctctgtctcaggagaagccaggcctaggtgcttgacctggtgatctgagctgtgtttgtcctagtatgggtggcagtcacctctgaacacactggccttggcttagaggaggcttgtgacttcagctgttccagctggggctggatgctggactctgattccctcagagagacagaagatcgggcagaggtcaaccagaaggccacacagggcagtggacaacagtggagggtataccaaatagaaataaaacgcaggaaacctctctgaatactgcccttggggacctcaggagggagtgggactgattggagacaaagagccagaaatcatcccctggagatactcagacactgtattgttattggcgctgtcctgtgagggcagtgtccaggctgccctgcttgtcatatccatgccctggctctggccccggtgagcacttgtgctgcatgaggaaaggaggatcaggtggggtcaaaaccaaagcatcgaggctggcactggccaagacagactctggcagggaggggagtggaaggaaggagccccaaacctggagtgagacctttgactttctgatgatgtggccaagaactaggagtcacctggccagcacagccaagagtggggctgggggcgcagccagctttaaggtgtcaacacctggcccttgcggggaaagagccttcagcagcccccacggcctggagcctgggtttattggagggtgctttcttaccctctgaacccagtggaggagggggcaatgggatattcctgctctgtatggcctctgggtcagctttttgttgcaaaatcctatcccccgctgctagattctttgaagcaagggagaagcaatagcccagcctcagaatgattctcaggaaagcaattccactgccagtggactgggtgccaggaggcctaggtctggatctggggctgccactaatgacaggaaagtgggcttatcctcaacctttctgagcctcagtgtcattatctgtaaaatggggatgataataccaggtagagttgctctgatgactggagaccatggagcggagtgtttgggaaatggcaaagatttgtgagggcttcgtgctttagagatttgctacccttaaccaccagcatcagctcacctgggaatctgtaagaaatgcagagtcctaggccccaccccagatctcctgattttaacaacattcccaggtgacttggatgcatgttaaagttggagaagctgccctaagtgacaaccctttgccttttcaggactttgcctctttccacagagctgcaggttctgtctaggctgcttttactgccatgggggctgcctggtccctgagtaagcagtgggtagccctggatggctgaggggctggggaagccagctgggccagaccaggaaggagcctgaggcacagcaccaaggcatggggtagggtgggctttgaggcacggcctccccatgcccagacccaggcccaaacaggaggctcctgtgcaccagcaagtgcagcaaagctggctgcagtgacaaggaagtcagagggagggctggtttgcctcaaccctcgccctggatgtggcaaaagataccacaccgaaggaagctgtaggggatctgggacttagtcaggctagctaagggcactgagtgattacagggcaaggccacagagcggcaggaagttgtaagtgcaggggccaggcacagtctgagtggagagccatgatggcactcatccctggctggctcctgggcccaggcccttgctcagaatacagtgcccaggcccgcctgggcattgccttaattcctgtctgaggctgccttccgtcatcctcctcaagctgactgctatcagcaggagaagggaatgcagaaccacccccaccccaactccagtgtctccagaactgagcagggaccctccccatgacggagacagacaacccaatggcagggcctgggggagttctaacctcccgtgcccaagcctgacttcccttccctctccagatactgaggaaagtgggttggaggtgggccatgagggtgggggacagggggagggagagccatttcctaagaagagcccaggttgtctcagcccagggagactggtttcaggagctgttccttcagaaaggacgatggaaatggaagtcacagcagggctggggaactggggactggttaggttggacccatgggtgcagcaccctccaaactggtgtcagagcctgcagatgagtcccgggaggagcggccctgcaggaagcggatgatcttctcaatggtggcctcctggtattcgtgggaccacctgtgggcacaggagccaatgtggttcagacagctgggcagagggagctgctagtcagctgtttgcccacactctgcctgtcatggtgatttgtaccctacccccctggtcccagggccctggggctcacttgataccgttgaaagtaagcacagcctgcatgtcctcaggcaggacctggggctcaggccactcgaagccatcaatgatgggcacaatgttcttgccgcagcttaaagcagtcacaatctcctggagaaagaaaggaaaggaggaagatacccctgtacccatctagggacccttgtagccaggcaggtgctgggaggcccactggcccgaggctgggcccagggcaggacaccagtcctgatgtccaccttgatgtctaccttaacccttgtagtgtaataaaaaataaatatttttcctttgcccagagttcctggcacagagctgctaaaacccttggaatctcttgagtgatgagtgtctttgtatgctaaagagatgattccccactgggggcccggggggtgctatgggggtagcctagatagtttcaggaagagggctggtcaccagggagaccagggcatgactagaggattggaactttcagccccacctcccagcctccagagaggtgctggagattgagttcaatcaccaatggccaatgatttaatcaatcatgcctacataatggaacctccataaaaacccccaaacaaggggttttgaagagcctccaggttgataaacaggtgtaggtgctgggaaggtggtagaaggcatggcatccacacctccaccctccatacgtagagatcctatgtatctcttccatttggctattcttgagctgtgtcctttataactgtgaaattaaataattcagctgggcatggtgggtcacgcctgtaatcccaacactttgggaggctgaggcaggaggatcacttgagcccaggattttgagattaataatattatttattactattattcaagctttgttaaatcaaacctaaagctcttggaactttaagttattctgagccttgacaggaattggtctctgcagcctgagtcatggggcatgcagctgcaacttccacctattttttttttttctgtaattacttaggaagaccaaatggcaccagagataagactcccttagatccccacttagatcaccaccctttctcagggggtaataaagtcatcttccttggaatgtagcaatctataaccaatcaaagcactgtaacatacgcactggtcttgtatggaaaatgttgtaatcctgctaaaattcctctctctttgcctgtggaagtgaaaccttaacttctccagtttggaatgctcaccccatgcctttggagtcaatgc

SEQ ID NO: 184376 - DNA, 5363 bp, Homo sapiens
  Payload ID: 16300
  Gene Symbol: SLC46A1
  Gene Name: solute carrier family 46 (folate transporter), member 1
  Uniprot ID: Q96NT5
  ENST ID: ENST00000618626
  CDS Start-End: 88-1383
gccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtgctctcttttctgctgtggcctgtgtgaatagcctggccatgctgacggcctccggcatcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactgaaacaaaccttctggtgccttgggctttggggccctctgttttcctgctcccagtctgcctgccatacgttagacaacagaagctgctgggctgggcaggagccctgagctgcctggtggattggtaccaagtggggccagccagggcttctactgactcgctgtgcaaccttgagcaagccccactaggaacggctagatcagcaatgccccaaattgttgaatcgtggtgatcacatttggatggacaagttaggaaacttagctgattctctgagatacttcccacttcctcatacattctacaatgagatgcctctcttcatgggcctggggaaaggatgaatgagtgtggctggacttttgacctttaatgtccctgagcagttcttggcccttggggagaagtagggggaggatctggctgactcagccccaaccgaggggtagcagctgcagcccagccaagcagaacaccctggccctacagacctgtgtctgagcaggctttggaggaaaggccacttctgagtcctctgtctcaggagaagccaggcctaggtgcttgacctggtgatctgagctgtgtttgtcctagtatgggtggcagtcacctctgaacacactggccttggcttagaggaggcttgtgacttcagctgttccagctggggctggatgctggactctgattccctcagagagacagaagatcgggcagaggtcaaccagaaggccacacagggcagtggacaacagtggagggtataccaaatagaaataaaacgcaggaaacctctctgaatactgcccttggggacctcaggagggagtgggactgattggagacaaagagccagaaatcatcccctggagatactcagacactgtattgttattggcgctgtcctgtgagggcagtgtccaggctgccctgcttgtcatatccatgccctggctctggccccggtgagcacttgtgctgcatgaggaaaggaggatcaggtggggtcaaaaccaaagcatcgaggctggcactggccaagacagactctggcagggaggggagtggaaggaaggagccccaaacctggagtgagacctttgactttctgatgatgtggccaagaactaggagtcacctggccagcacagccaagagtggggctgggggcgcagccagctttaaggtgtcaacacctggcccttgcggggaaagagccttcagcagcccccacggcctggagcctgggtttattggagggtgctttcttaccctctgaacccagtggaggagggggcaatgggatattcctgctctgtatggcctctgggtcagctttttgttgcaaaatcctatcccccgctgctagattctttgaagcaagggagaagcaatagcccagcctcagaatgattctcaggaaagcaattccactgccagtggactgggtgccaggaggcctaggtctggatctggggctgccactaatgacaggaaagtgggcttatcctcaacctttctgagcctcagtgtcattatctgtaaaatggggatgataataccaggtagagttgctctgatgactggagaccatggagcggagtgtttgggaaatggcaaagatttgtgagggcttcgtgctttagagatttgctacccttaaccaccagcatcagctcacctgggaatctgtaagaaatgcagagtcctaggccccaccccagatctcctgattttaacaacattcccaggtgacttggatgcatgttaaagttggagaagctgccctaagtgacaaccctttgccttttcaggactttgcctctttccacagagctgcaggttctgtctaggctgcttttactgccatgggggctgcctggtccctgagtaagcagtgggtagccctggatggctgaggggctggggaagccagctgggccagaccaggaaggagcctgaggcacagcaccaaggcatggggtagggtgggctttgaggcacggcctccccatgcccagacccaggcccaaacaggaggctcctgtgcaccagcaagtgcagcaaagctggctgcagtgacaaggaagtcagagggagggctggtttgcctcaaccctcgccctggatgtggcaaaagataccacaccgaaggaagctgtaggggatctgggacttagtcaggctagctaagggcactgagtgattacagggcaaggccacagagcggcaggaagttgtaagtgcaggggccaggcacagtctgagtggagagccatgatggcactcatccctggctggctcctgggcccaggcccttgctcagaatacagtgcccaggcccgcctgggcattgccttaattcctgtctgaggctgccttccgtcatcctcctcaagctgactgctatcagcaggagaagggaatgcagaaccacccccaccccaactccagtgtctccagaactgagcagggaccctccccatgacggagacagacaacccaatggcagggcctgggggagttctaacctcccgtgcccaagcctgacttcccttccctctccagatactgaggaaagtgggttggaggtgggccatgagggtgggggacagggggagggagagccatttcctaagaagagcccaggttgtctcagcccagggagactggtttcaggagctgttccttcagaaaggacgatggaaatggaagtcacagcagggctggggaactggggactggttaggttggacccatgggtgcagcaccctccaaactggtgtcagagcctgcagatgagtcccgggaggagcggccctgcaggaagcggatgatcttctcaatggtggcctcctggtattcgtgggaccacctgtgggcacaggagccaatgtggttcagacagctgggcagagggagctgctagtcagctgtttgcccacactctgcctgtcatggtgatttgtaccctacccccctggtcccagggccctggggctcacttgataccgttgaaagtaagcacagcctgcatgtcctcaggcaggacctggggctcaggccactcgaagccatcaatgatgggcacaatgttcttgccgcagcttaaagcagtcacaatctcctggagaaagaaaggaaaggaggaagatacccctgtacccatctagggacccttgtagccaggcaggtgctgggaggcccactggcccgaggctgggcccagggcaggacaccagtcctgatgtccaccttgatgtctaccttaacccttgtagtgtaataaaaaataaatatttttcctttgcccagagttcctggcacagagctgctaaaacccttggaatctcttg

SEQ ID NO: 184377 - DNA, 2502 bp, Homo sapiens
  Payload ID: 16301
  Gene Symbol: SLC46A2
  Gene Name: solute carrier family 46, member 2
  Uniprot ID: Q9BY10
  ENST ID: ENST00000374228
  CDS Start-End: 233-1660
ctcgggaggtcactcggctgctgggcgggctgctgtcacaggcgctgcgtgccctggctctgctcgccactggccggcgcgctcccggcgcacggagcacactcgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcctcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttgctctttgtgggtgctatcatatatgacctggcggtggtgggcacagtggacgtgatccctctttttgtgctgagggagcctctcggttggaaccaagtgcaggtgggctatggtatggctgcagggtacaccatcttcatcaccagcttcctgggtgtcctggtcttctcccgctgctttcgggacaccaccatgatcatgattgggatggtctcctttgggtcaggagccctcctcttggcttttgtgaaagagacatacatgttctatattgctcgagccgtcatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacgaacaatgtcttttaaattaaaataaaaccttgaaaaaagtcagctttctttcctgagtcttccttacctacaaacactcaggagggggatggagctcaggcccttgtcttctgggtagttttgttactactgttgcttttaagaagcaaatgtcacaaggctttcttcaatgggatgttcaattgagtacttccagtcaacagtgcttcccaaagtgggtggtgtgaaggaagaggaggtacattaagagctattttatttgaggtagtcatttttataaccttgtttacttggatttataaaagcagactcacctaataaaatcaacattcattgta

SEQ ID NO: 184378 - DNA, 1890 bp, Homo sapiens
  Payload ID: 16301
  Gene Symbol: SLC46A2
  Gene Name: solute carrier family 46, member 2
  ENST ID: ENST00000491462
  CDS Start-End: 130-1155
cgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcctcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttgctctttgtgggtgctatcatatatgacctggcggtggtgggcacagtggacgtgatccctctttttgtgctgagggagcctctcggttggaaccaagtgcagctcgagccgtcatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacga

SEQ ID NO: 184379 - DNA, 3173 bp, Homo sapiens
  Payload ID: 16302
  Gene Symbol: SLC46A3
  Gene Name: solute carrier family 46, member 3
  Uniprot ID: Q7Z3Q1
  ENST ID: ENST00000266943
  CDS Start-End: 371-1756
gcgccgcgctgaggccgaggtccgcagggccgcggggaagccgagggctgccggagaaccctgcaggtgtcactcgggacgcggaagtgcgcttgccgaggtttgctttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttattttttctcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttattttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtactccttaaatttgaatccgtcaacacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaa

SEQ ID NO: 184380 - DNA, 2121 bp, Homo sapiens
  Payload ID: 16302
  Gene Symbol: SLC46A3
  Gene Name: solute carrier family 46, member 3
  Uniprot ID: Q7Z3Q1
  ENST ID: ENST00000380814
  CDS Start-End: 500-1891
ggacagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgaggtccgcagggccgcggggaagccgagggctgccggagaaccctgcaggtgtcactcgggacgcggaagtgcgcttgccgaggtttgctttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttattttttctcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaa

SEQ ID NO: 184381 - DNA, 3280 bp, Homo sapiens
  Payload ID: 16303
  Gene Symbol: SLC47A1
  Gene Name: solute carrier family 47 (multidrug and toxin extrusion), member 1
  Uniprot ID: Q96FL8
  ENST ID: ENST00000270570
  CDS Start-End: 87-1799
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagaga

SEQ ID NO: 184382 - DNA, 1998 bp, Homo sapiens
  Payload ID: 16303
  Gene Symbol: SLC47A1
  Gene Name: solute carrier family 47 (multidrug and toxin extrusion), member 1
  Uniprot ID: Q96FL8
  ENST ID: ENST00000395585
  CDS Start-End: 61-1821
ccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggctggagtgcggtggtgcgatcatagctcactgcagcctcgaactcttgggcttcaagcaatcctcctgtgtcagccaccagagtagctgagactacagggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaa

SEQ ID NO: 184383 - DNA, 1719 bp, Homo sapiens
  Payload ID: 16303
  Gene Symbol: SLC47A1
  Gene Name: solute carrier family 47 (multidrug and toxin extrusion), member 1
  ENST ID: ENST00000436810
  CDS Start-End: 113-1444
agagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcgacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacag

SEQ ID NO: 184384 - DNA, 2224 bp, Homo sapiens
  Payload ID: 16303
  Gene Symbol: SLC47A1
  Gene Name: solute carrier family 47 (multidrug and toxin extrusion), member 1
  ENST ID: ENST00000575023
  CDS Start-End: 65-871
actgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaa

SEQ ID NO: 184385 - DNA, 414 bp, Homo sapiens
  Payload ID: 16303
  Gene Symbol: SLC47A1
  Gene Name: solute carrier family 47 (multidrug and toxin extrusion), member 1
  ENST ID: ENST00000581558
  CDS Start-End: 1-298
tttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctgctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagc

SEQ ID NO: 184386 - DNA, 1415 bp, Homo sapiens
  Payload ID: 16303
  Gene Symbol: SLC47A1
  Gene Name: solute carrier family 47 (multidrug and toxin extrusion), member 1
  ENST ID: ENST00000571335
  CDS Start-End: 421-1371
aaccccacacaccccgcggggtgctaaccgagtcacggctcgaggcctctgggtccttccacgccaggtcattcagaacctgaaacccccagcggaggtggagagccgggttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccaggttgagttccagcccgatggccagatctcctggaaatgtgtgtgtcccccccacaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagctta

SEQ ID NO: 184387 - DNA, 2258 bp, Homo sapiens
  Payload ID: 16304
  Gene Symbol: SLC47A2
  Gene Name: solute carrier family 47 (multidrug and toxin extrusion), member 2
  Uniprot ID: Q86VL8
  ENST ID: ENST00000325411
  CDS Start-End: 52-1860
ctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggcacagcctgctgctcaagtctgtcataaa

SEQ ID NO: 184388 - DNA, 2285 bp, Homo sapiens
  Payload ID: 16304
  Gene Symbol: SLC47A2
  Gene Name: solute carrier family 47 (multidrug and toxin extrusion), member 2
  Uniprot ID: Q86VL8
  ENST ID: ENST00000350657
  CDS Start-End: 176-1918
agtgccctaggaggcagggctcatcccacaagttgccatggtagcccctcctcctgccccttactcatcagccaggctgtaccgacacgggctgcccaggcagggggtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgagacacagccatcgtcttgcttatgcagcccatgtcactcggattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctg

SEQ ID NO: 184389 - DNA, 1264 bp, Homo sapiens
  Payload ID: 16304
  Gene Symbol: SLC47A2
  Gene Name: solute carrier family 47 (multidrug and toxin extrusion), member 2
  ENST ID: ENST00000433844
  CDS Start-End: 176-1264
agtgccctaggaggcagggctcatcccacaagttgccatggtagcccctcctcctgccccttactcatcagccaggctgtaccgacacgggctgcccaggcagggggtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaat

SEQ ID NO: 184390 - DNA, 1962 bp, Homo sapiens
  Payload ID: 16304
  Gene Symbol: SLC47A2
  Gene Name: solute carrier family 47 (multidrug and toxin extrusion), member 2
  Uniprot ID: Q86VL8
  ENST ID: ENST00000574239
  CDS Start-End: 19-678
ccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcaggcaggtgagaggctgtgcgtcccagcctcttccaactcctcaacagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagagggg

SEQ ID NO: 184391 - DNA, 1024 bp, Homo sapiens
  Payload ID: 16305
  Gene Symbol: SLC48A1
  Gene Name: solute carrier family 48 (heme transporter), member 1
  Uniprot ID: Q6P1K1
  ENST ID: ENST00000442892
  CDS Start-End: 213-482
gggaaaaggaggaagagggagttaaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttca

SEQ ID NO: 184392 - DNA, 3010 bp, Homo sapiens
  Payload ID: 16305
  Gene Symbol: SLC48A1
  Gene Name: solute carrier family 48 (heme transporter), member 1
  Uniprot ID: Q6P1K1
  ENST ID: ENST00000442218
  CDS Start-End: 98-538
gctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaga

SEQ ID NO: 184393 - DNA, 577 bp, Homo sapiens
  Payload ID: 16305
  Gene Symbol: SLC48A1
  Gene Name: solute carrier family 48 (heme transporter), member 1
  ENST ID: ENST00000549243
  CDS Start-End: 529-577
cgtaggggaagggggccggcactggcaggctttggagtccgcacccgggggtaccagagtggacatccgcctgagcccagagtatccccagggggcaggagcggccccgaagtgtgtggaggaggccgcaacggccggggtgtcagggatccggcggtcatctgctgtgtccacacattaagaaacgctggtggagttttaaatgcctctccggggaaggaggaaagcctgagaatgaatctgacctcagacccaaatccattcaacggagttctggtaatttggaagaaggaagagcaacctggaaactgacaggaaaggatgacaagttgggagtcacaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggct

SEQ ID NO: 184394 - DNA, 751 bp, Homo sapiens
  Payload ID: 16305
  Gene Symbol: SLC48A1
  Gene Name: solute carrier family 48 (heme transporter), member 1
  Uniprot ID: Q6P1K1
  ENST ID: ENST00000547002
  CDS Start-End: 456-725
gccgtgcaggctctagcaaaaggctggggggtccccagcgacccccatcagctttgataaggggatccggagggtgccagtgggtcatctgctgtgtccacacattaagaaacgctggtggagttttaaatgcctctccggggaaggaggaaagcctgagaatgaatctgacctcagacccaaatccattcaacggagttctggtaatttggaagaaggaagagcaacctggaaactgacaggaaaggatgacaagttgggagtcacaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccct

SEQ ID NO: 184395 - DNA, 1070 bp, Homo sapiens
  Payload ID: 16305
  Gene Symbol: SLC48A1
  Gene Name: solute carrier family 48 (heme transporter), member 1
  ENST ID: ENST00000551301
  CDS Start-End: 91-249
cggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagcctt

SEQ ID NO: 184396 - DNA, 618 bp, Homo sapiens
  Payload ID: 16305
  Gene Symbol: SLC48A1
  Gene Name: solute carrier family 48 (heme transporter), member 1
  ENST ID: ENST00000548498
  CDS Start-End: 510-618
aggtcagagaatggccctagtccatgagcactgaggaagggactttaaggaatccctctcattttgacaaggaaagcaaaagcccagagagatcacacaactatttagaaaggtaggaacagaaagagctgtcttcagacttcttctctgggaggttgatgggttttccccttggctttcgaagagggaggtctggcctcaataactggcagtgctgtcttcctgggactcgggctccaccccttcaccatgggcgtgcatgctcacagctggcactcattccctcacggaagccttccctgggctaaaggcatcatcaagaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcg

SEQ ID NO: 184397 - DNA, 2030 bp, Homo sapiens
  Payload ID: 16306
  Gene Symbol: SLC5A4
  Gene Name: solute carrier family 5 (glucose activated ion channel), member 4
  Uniprot ID: Q9NY91
  ENST ID: ENST00000266086
  CDS Start-End: 13-1992
ctgcctgcagccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccacatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattcttaa

SEQ ID NO: 184398 - DNA, 5152 bp, Homo sapiens
  Payload ID: 16307
  Gene Symbol: SLC5A7
  Gene Name: solute carrier family 5 (sodium/choline cotransporter), member 7
  Uniprot ID: Q9GZV3
  ENST ID: ENST00000264047
  CDS Start-End: 277-2019
ctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttcaggagagtaaaaattcatataaagtgcaattgcacaaatacaagccaagctagaaggaagcacctatgaaagcaacaactttgtttctcatccatagtagtattgattttgatgctagatagttttgctaggtataaaaaataagtaaagttccacttagagaacaaagggccaaatagagtttttatatttgttatgataaaaggaagtagatgtgaaaaagcctaagaaaaaggaaattggacagttttgatacaaactttgtttgctaatgcactgatgagtctagtttcattatagcacgaagctatgagaataacttcagtcactcccttgaatggtgcaatgaattaaccagctgatttttcttagtgtgatgattaaccccttctttcatgttctgagctataacatttgctgaatatgcaatttgttattcttttattaatggcatgtaatattctgagcacgggcaaagaaaacacacaaaagattatgtattggcatttatttatgtgcaaggtgataggaaaactgaatccatctttgtagaagagcactgggctaatttgtatgtttccatagctactatatgcataaacaacagtacctgaaggattattaagcaaccttaaagcaataagttcattaaacagaaggtaataggaagaacagtacatttttgtctttatctcaagtatataaagttttgccccatgataaaataagtaacatataaattaatacataagttaatattggaagtgaaattaggccttatgtaaggagaggtagctacacagcatctgttacggttaatgagaggcacactgctaaatttacgtatatttcattgaatactttatgggaagcctccacaacacctcctgatagtagtaaaattagaaaaaaacaaactctactaatttttagatattcattaataggaaagatttaatgttacagcatctactctttggcactttttcacataagccagccttagagactagacaaataactactgcaaaaagtacatagtgaattttaaaatgtagaagaaagcaaaaaataaaataagtcctaaagtgaagaagccatcaattttaacatttgatgtctagataacattcatgagattggtcattaaatactattttgctccttttctggtgttacacatacacactcatacgtgtgtgtgtgtgtatgtgtgtgtgtgtatgtgtaatgatttgtgtccatttcaagtgttttcacaccagtcacacattatagaaattactggagccatgtctacaaaagcaaagtgaagtgatgagctgaaaagtgatcagggaatctgatcccataaagaaagtgagtctgaattgttgaaactaaagcacttcttttccaaaaatacttctgcaactcatgaacaaaatgaagttaacttagtgtttagcattaaaaataaaagttgtaccttgaccctagaattccttttataagatttaattgtaattgtctcaaagcatcaaataatacatctttatcattaaacatgaatttaatgtctaggataatttttaaaagaggaaattaaataattttacatgtctcatattttcagtgctttctcaaaatttgatggtgaatattacattgcattcaaaatcttcactgaatatcatatgtatctaaatgaaaagagaattacttatattcatctattttctcagaatctattcagtaccctatggagtacatggaagaagtatatttttggaaccagtaagtatgggagtccacgattctcaggtattgattgaaaaaagagaaaggggcaagaaattcattaaagaaaaaccacagatactgaaacatttgacacataaaagtaattaattgctggagactacaattcctggcaaacaccattattccagatgcaccatgctacccagcatgctacctgaatggcggtttttatccatcctgtcaccctgagcatctgtctcaacctgctgaggcacagacttccaccatgtgcatcaggaaacacctcactcatactgtcatataatgcaacagggaggcatagtctctctacaggtctctctctttacgttgtaccattctgttgggcaacaattgtcccaacaaccacacttaaatccagtggggaaaaaaaggttaacagtaaaaatttcttccacgtaattcaatttctcacaatagacagaaacagggggaaaatgtttgccctgttcaaagtactaaaactagataacttaaataatttaagccaataaataatattatattgtatttaacccattattcctcacctaccctcaaagtaggtatacaaaagactagtttgttattaatccacaaatatgctaaatgttagcaagatgatttttaagtacaaaaaagtttaagattgcaaggaaggaaacaatggtcacaaggtctttacttatgcacatttgtgcataaatttccacccaatttccaagacagttgtatcacaaagctgtgaaatgtgcaagagtatactttgtacccatcatgtgctctgttttgacataatgagtaatgcagacatttacatgttcttccagcttcaatcagtagacctgattttcaaaatctgccctcagatgaaaataaaataaacgaaacatttagacaatggctatattaatctgggaaggcaacacctgtggataaaacattagaagaaaacatatattttattttcatacttttgatatgattgtaacatatttcttgagtaatttaaatgctttgttttcccacacatattcaaatcagcaagcttgtagctggactgcaatatcaacaacaagttgtttcaaacagcatcaaaatacaacttcattgctacacttacaagtaatgaattttatgtgactatgaaacgaatataagcttaaaataagtgaatctaataaaatggctattcctctttttacttggaaataataaattaacattatattttaaacataaa

SEQ ID NO: 184399 - DNA, 2032 bp, Homo sapiens
  Payload ID: 16307
  Gene Symbol: SLC5A7
  Gene Name: solute carrier family 5 (sodium/choline cotransporter), member 7
  Uniprot ID: Q9GZV3
  ENST ID: ENST00000409059
  CDS Start-End: 290-2032
cgattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtga

SEQ ID NO: 184400 - DNA, 5061 bp, Homo sapiens
  Payload ID: 16308
  Gene Symbol: SLC5A1
  Gene Name: solute carrier family 5 (sodium/glucose cotransporter), member 1
  Uniprot ID: P13866
  ENST ID: ENST00000266088
  CDS Start-End: 251-2245
ccccattcgcaggacagctcttacctgccgggccgccgccccagccaacagctcagccgggtgctccttcctgggctccacgcccggagctgcttcctgacggtgcagccgcaaggcatcgcaggggccccgcgctactgccctgctccctcaaagtcccaggtcccctcccctggtgctgatcattaaccaggaggccgtataaggagctagcggccctggcgagagggaaggacgcaacgctgccaccatggacagtagcacctggagccccaagaccaccgcggtcacccggcctgttgagacccacgagctcattcgcaatgcagccgatatctccatcatcgttatctacttcgtggtagtgatggccgtcggactgtgggctatgttttccaccaatcgtgggactgttggaggcttcttcctggcaggccgaagtatggtgtggtggccgattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactctgtcttccgtggccttccttttgtctgtgtcctaaatctactcttctgataaggacatcagtcatattggaataggacccaccctaatgtcttcattttaatcacctctttaaagcccctacctccaaatacagtcacactgtgagaaactgagggttaggaagtcagcaagtgagtcttgaagagatactaaacaaacccacaacacagataaagtatgcattttggagatttccaagccagagtctcccgtgaaaaaggtaaacggaagcagttattgtgcagcaaaaggaaaaagaattacaaactgaacgtatgtaggtgaggcaaggcagggtagggcagggcctttgggtaggctgatcagagggtttttcaacaataaatcaatgggaatgcatttgttgctcccaggaccctggcaccttgactctggtactatagcatgtcagcaaatacaagcaaagcccaacactctgatttgcatttatgccaatctaaactatccggtgtttagtttgattttttgagtgcaggttcattcaaggaccaggttcccttgtgctcagggtgaagtagaaccagaaaacatcgttatccattcccagaagttttggaagagccttggtagaaaagcagaagctgctttgaccgtgaaaatatttgactcctatcagtttttggtcaggagaagatatccacctagaccaacctgaggagaaggctcagagtacagatataccccgagcaacgtgatcaatgtccttgaaccttcatttttcatctgaaaacagagacataaatgcctggctcacagatttaaatgttatacattgacagcatttatcagtataacatttatttaaataagtaggtgctcaataggtgttggtcttctaacttgtctacatcccatccccattccagggtcttcagaattgaaggagagatgttgtatcactgttagaaggctgctttgggacattctgcagcagggaggagggactgtcaacccctacaccatgaccaccaagttcctcaccttggctgagtccctaaaactctctgaacctcaggttcctccaagcataatgcagacttcacagagctgttgtaaagattaggtgaggtcaattgatactgcttaaaaggcccggtccgtagaaaatgcccaataaacattactgctttccccctcaccctactgcctgaaaaaatattacacctgtgagactgactttgagaaccagtgtgggtggggagttgtgcatataaactatttaatgagtaccaaacacaaaagtcaagcttgtaaaatatcaggccttgccccagaaagacaaataccacatgatctcactgatatgtagaatcttaaaaagtcaaactcagaagcagagagtagaatgatggttatcaagggctgggggagggagggactggggagatgttggtcaaatgatacaaaggtttagttaggtggaataagttcagaaaatcaattgtacaatgtatcaattatagttaatagcaatataacatatacttgaaaattgctgagagtagtgtgagtgttctaccacaaaaaaatatgtgcagtaatagatgttaattaccttaatttagtcatttcacaatatgtacatatataaaaatatgttgtatgccatgagtatatataattattatttgtgaatttaaaaaataaaaataatttccaaaaaaa

SEQ ID NO: 184401 - DNA, 4752 bp, Homo sapiens
  Payload ID: 16308
  Gene Symbol: SLC5A1
  Gene Name: solute carrier family 5 (sodium/glucose cotransporter), member 1
  Uniprot ID: P13866
  ENST ID: ENST00000543737
  CDS Start-End: 350-1963
acagtgagccgagatcatgccactgcactcctgcctgggcgacagaaaaagactctgtcccaaaagtgggctctttgaaggctagaaggtatttggggcagcagacttgtgtggaagcagttatcaaagtggggatgtgacacgcaccaggagaggggaacagacaacacatgagattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactctgtcttccgtggccttccttttgtctgtgtcctaaatctactcttctgataaggacatcagtcatattggaataggacccaccctaatgtcttcattttaatcacctctttaaagcccctacctccaaatacagtcacactgtgagaaactgagggttaggaagtcagcaagtgagtcttgaagagatactaaacaaacccacaacacagataaagtatgcattttggagatttccaagccagagtctcccgtgaaaaaggtaaacggaagcagttattgtgcagcaaaaggaaaaagaattacaaactgaacgtatgtaggtgaggcaaggcagggtagggcagggcctttgggtaggctgatcagagggtttttcaacaataaatcaatgggaatgcatttgttgctcccaggaccctggcaccttgactctggtactatagcatgtcagcaaatacaagcaaagcccaacactctgatttgcatttatgccaatctaaactatccggtgtttagtttgattttttgagtgcaggttcattcaaggaccaggttcccttgtgctcagggtgaagtagaaccagaaaacatcgttatccattcccagaagttttggaagagccttggtagaaaagcagaagctgctttgaccgtgaaaatatttgactcctatcagtttttggtcaggagaagatatccacctagaccaacctgaggagaaggctcagagtacagatataccccgagcaacgtgatcaatgtccttgaaccttcatttttcatctgaaaacagagacataaatgcctggctcacagatttaaatgttatacattgacagcatttatcagtataacatttatttaaataagtaggtgctcaataggtgttggtcttctaacttgtctacatcccatccccattccagggtcttcagaattgaaggagagatgttgtatcactgttagaaggctgctttgggacattctgcagcagggaggagggactgtcaacccctacaccatgaccaccaagttcctcaccttggctgagtccctaaaactctctgaacctcaggttcctccaagcataatgcagacttcacagagctgttgtaaagattaggtgaggtcaattgatactgcttaaaaggcccggtccgtagaaaatgcccaataaacattactgctttccccctcaccctactgcctgaaaaaatattacacctgtgagactgactttgagaaccagtgtgggtggggagttgtgcatataaactatttaatgagtaccaaacacaaaagtcaagcttgtaaaatatcaggccttgccccagaaagacaaataccacatgatctcactgatatgtagaatcttaaaaagtcaaactcagaagcagagagtagaatgatggttatcaagggctgggggagggagggactggggagatgttggtcaaatgatacaaaggtttagttaggtggaataagttcagaaaatcaattgtacaatgtatcaattatagttaatagcaatataacatatacttgaaaattgctgagagtagtgtgagtgttctaccacaaaaaaatatgtgcagtaatagatgttaattaccttaatttagtcatttcacaatatgtacatatataaaaatatgttgtatgccatgagtatatataattattatttgtgaattt

SEQ ID NO: 184402 - DNA, 2271 bp, Homo sapiens
  Payload ID: 16309
  Gene Symbol: SLC5A2
  Gene Name: solute carrier family 5 (sodium/glucose cotransporter), member 2
  Uniprot ID: P31639
  ENST ID: ENST00000330498
  CDS Start-End: 20-2038
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgt

SEQ ID NO: 184403 - DNA, 1852 bp, Homo sapiens
  Payload ID: 16309
  Gene Symbol: SLC5A2
  Gene Name: solute carrier family 5 (sodium/glucose cotransporter), member 2
  Uniprot ID: P31639
  ENST ID: ENST00000419665
  CDS Start-End: 20-1396
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacgggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctg

SEQ ID NO: 184404 - DNA, 516 bp, Homo sapiens
  Payload ID: 16309
  Gene Symbol: SLC5A2
  Gene Name: solute carrier family 5 (sodium/glucose cotransporter), member 2
  ENST ID: ENST00000569576
  CDS Start-End: 71-516
attcagctaaacaaagctggggagcgggaatgagacctgggggacttgtcggctcagtgcccctgagtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacagg

SEQ ID NO: 184405 - DNA, 2745 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000347898
  CDS Start-End: 623-2650
ggttgctgttcctgttgctgccactgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactgggtgagtgaagcaggatggtgccttgggctccagcgtctccccaacccctccatgccatgggtccccacgcaggtgaggaccctggtggaggacggtgtgggcagagcgtgggacatgtcaccttccccacctgctcagagttcaagggtcctgggctgggccccgttctctcttctgccctggggagatcattcacgcttcctttaatccccgctgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 184406 - DNA, 2069 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000449109
  CDS Start-End: 415-1974
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 184407 - DNA, 2399 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000424767
  CDS Start-End: 382-2304
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 184408 - DNA, 2294 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000545376
  CDS Start-End: 382-2199
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccaggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaagg

SEQ ID NO: 184409 - DNA, 2246 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000567758
  CDS Start-End: 233-2155
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccac

SEQ ID NO: 184410 - DNA, 591 bp, Homo sapiens
  Payload ID: 16310
  Gene Symbol: SLC5A11
  Gene Name: solute carrier family 5 (sodium/inositol cotransporter), member 11
  ENST ID: ENST00000569520
  CDS Start-End: 319-591
acagtggaagactgggtgagtgaagcaggatggtgccttgggctccagcgtctccccaacccctccatgccatgggtccccacgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggt

SEQ ID NO: 184411 - DNA, 2139 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000568579
  CDS Start-End: 233-2050
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccaggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacc

SEQ ID NO: 184412 - DNA, 1919 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000569071
  CDS Start-End: 266-1825
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaag

SEQ ID NO: 184413 - DNA, 2214 bp, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENST ID: ENST00000565769
  CDS Start-End: 289-2124
ggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacca

SEQ ID NO: 184414 - DNA, 2703 bp, Homo sapiens
  Payload ID: 16310
  Gene Symbol: SLC5A11
  Gene Name: solute carrier family 5 (sodium/inositol cotransporter), member 11
  ENST ID: ENST00000488922
  CDS Start-End: 382-570
actgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatgggtgggatctccctctgttgctcagggtactagaacgcagtggtggcaatcatagctcactccggcctcgacttcttgggctcaagtgatcctctcacctcggctgccagacacagaggaggtactatctacgaggaacaggctctcaccagacaccaaacctctcggtgccttgatattgaacttccaagtctccagaatttccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaa

SEQ ID NO: 184415 - DNA, 3576 bp, Homo sapiens
  Payload ID: 16311
  Gene Symbol: SLC5A5
  Gene Name: solute carrier family 5 (sodium/iodide cotransporter), member 5
  Uniprot ID: Q92911
  ENST ID: ENST00000222248
  CDS Start-End: 348-2279
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtattagacgctgcagccctgacggctccccccaaataaggctgggtttttctctctctcttttttttttttttttttttttgagacagggtcatgctctgtcacccaggctggagtgcagtggtgtgatctcggctcactgcaacctctgcctcccaggctcaagtgattctcctgcctcagcctcttgagtagctgggattgtaggtgcccaccaccatgcccagccaactttttgtatttttagtagagacagggtttcaccatgttggtcaggctggtctcgaactcctgacctcaagtgatccacctgcctcggcctcccaaagtgctgggttacaggcgtaagctaccatgcccagcctaccgtttttctcaatctataatagaaagccaccacgcccaggtaatttttgtaattttgtatttttgtagagacggggttttgccatgttggccaggctggtctcaaactcctgatctcaggtgatcctcctgccttggcctcccaaagggctgggattacaggggtgagccaccgcgccccacctctttcttattttcttcctgggattggggaggggatgattcagaccccacatggcctccaaccttggcccacacacctgccatggctcccatcatcctgagcatgctagcgtcccctcctcacctgacaatggaggctctcgaattgggttgtgtccccccaaaatttatgtctacccagaacctcagaacatgagcttacttggaaatagggtctttgcaggtgtaactggttaaattaaaagaggtattactggaggaggatggatgaatccagtgactggttcctcatatgaagtagagaagagatgcagagaaacacatggggaagatgccacgtgaagacagaggcagtggttggatcaatgcatctacgagtcggagaacccaaggattgccagcaacaaccagaaatcaggaggggggcatgagatgcattatttcttagagcctttagagggaacatggccctactgacaccttgatgtcagacttctggctgctagaactgtcagagaataaatttctgttgtttgatgcca

SEQ ID NO: 184416 - DNA, 2269 bp, Homo sapiens
  Payload ID: 16312
  Gene Symbol: SLC5A12
  Gene Name: solute carrier family 5 (sodium/monocarboxylate cotransporter), member 12
  Uniprot ID: Q1EHB4
  ENST ID: ENST00000280467
  CDS Start-End: 286-1476
ctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgagtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtaggtacagctggtggactttctattccatatcatgaaatgtacatgtggtagatgtcaaaatcctgcatgtgctattcaggacacacttataaacacaaatgcactgtgagatatgtgaagaatcccacacatagattcttacacttccaaagatccagcagggtatcaggaaagaatgactagctagtttaccttaactgcctttattttcagatactcttctatacttaccctacactctagacgaggcttatccaacccacggcctgtgggccgcatacggcccaggatggctttgaatgcagcccaacacaaattcgtaaactttcttaaaacattctggaatttttttgtaattttttaaatcttagcagctatcattagtgtttgtgtattttatgtgtactccaaggcaactccttctttcaacgtggcccagggaggccaaaagattggacacccctgcaaactaatcacatcaatctctcttgattacactgtgtgatggtcatattagtctctctacatgggaagatgttgtgcttactatggccagtcactttgacaaagaaaagccaaattcttttctaaagaattgttccttattaccaaactcccagtaaccccctcaaagaataattgccccttgcttaatcatgcaattgcatattatgtttatactcacttcagcacttatcagagataattgcagtttcacaaggtttactttttaaagtataaacaaattatgtatttacttactaatagaaaatataggtaatttggggaaatttatgtacattgttaaataaaattatatctatctaa

SEQ ID NO: 184417 - DNA, 6250 bp, Homo sapiens
  Payload ID: 16312
  Gene Symbol: SLC5A12
  Gene Name: solute carrier family 5 (sodium/monocarboxylate cotransporter), member 12
  Uniprot ID: Q1EHB4
  ENST ID: ENST00000396005
  CDS Start-End: 311-2167
ctgaattccttctctgtggcatatgctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgagtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctgtcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaaaccaacctgctccaaatgcccttgactacttccttcttgaataaattagggctggatttcattaccattcaagaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaaagaagaaagaaagaaagaaaaagacaggaagaggaagagagagacagaaagaataaaaaaacagcaattctgaggatgagaataaattaatggtaggtattacatatgcatatacatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgtatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaaat

SEQ ID NO: 184418 - DNA, 814 bp, Homo sapiens
  Payload ID: 16312
  Gene Symbol: SLC5A12
  Gene Name: solute carrier family 5 (sodium/monocarboxylate cotransporter), member 12
  ENST ID: ENST00000533617
  CDS Start-End: 363-814
ggaatttaaacagaggacacagacagctcttgggagagtcttcatatttttattgatgagaatcctgaagcacagatcacagagtgagatgccagcaaatctcaaactggaattcaaggaggctgatttctgatcagtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggc

SEQ ID NO: 184419 - DNA, 1932 bp, Homo sapiens
  Payload ID: 16312
  Gene Symbol: SLC5A12
  Gene Name: solute carrier family 5 (sodium/monocarboxylate cotransporter), member 12
  ENST ID: ENST00000527405
  CDS Start-End: 347-1180
ggtaaatatattaaagaccaagatttgcagtaacatttatcatatcaaatctccaaatctagtggaggaatttaaacagaggacacagacagctcttgggagagtcttcatatttttattgtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtaggtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctgtcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaaaccaacctgctccaaatgcccttgactacttccttcttgaataaattagggctggatttcattaccattcaagaaa

SEQ ID NO: 184420 - DNA, 4178 bp, Homo sapiens
  Payload ID: 16313
  Gene Symbol: SLC5A8
  Gene Name: solute carrier family 5 (sodium/monocarboxylate cotransporter), member 8
  Uniprot ID: Q8N695
  ENST ID: ENST00000536262
  CDS Start-End: 560-2392
attaacctatcaaataaggcagtctaaaaactccaggcgtccctttccgtaaggacccggactgttgaactggaaagctaaaattcaaggcgtgacaattgccctttgtcccacattcctccaccggtcgcctgcttatttaaatggtgcgtcccctcgggtaccacttgaacaaaacctgcccagagcgctccctgtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaagttgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgatgacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatacatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaatttaaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 184421 - DNA, 3983 bp, Homo sapiens
  Payload ID: 16313
  Gene Symbol: SLC5A8
  Gene Name: solute carrier family 5 (sodium/monocarboxylate cotransporter), member 8
  Uniprot ID: Q8N695
  ENST ID: ENST00000572861
  CDS Start-End: 364-2196
gtgtagattcgctggaagcagctggaggctccagttctcatctgctcaggtgtccccggcgccttggcgaactcggccactccagttcctcacgtggtgagcactcagggcagcgggtcgattttccgaggtcccatacctgggtttgaggggcgcggctcgcagcggcgggtgcaggggcgactgccagccctcaccccgcctcggggtgcgttcggaggccgacacctggaggacgcctccagtccccgcgggacgccacgcctgcgcgccagggatccgggataagaagtgcgcgccgggctccggctgcgcgccgcggggccaccagtttgcgcgcagggctcaggcgaccgtgcggccatggacacgccacggggcatcggcaccttcgtggtgtgggactacgtggtgttcgcgggcatgctggtcatctcggccgccatcggcatctactacgccttcgctgggggcggccagcagacctccaaggacttcctgatgggcggccgcagaatgaccgcagtgcccgtggcgctgtccctcaccgctagcttcatgtcagccgtcactgtcctgggcaccccctccgaggtctaccgttttggggccatttttagcatctttgccttcacctacttctttgtggtggtcatcagcgcggaggtcttcctcccggtgttctacaaactgggaattaccagcacctacgagtatttagaacttcgatttaacaaatgtgttcgtctctgtggaacagtcctcttcattgttcaaacaattctgtatactggaattgttatttatgcccctgccctggctttgaatcaagtcacaggatttgatctgtggggcgcggtagtggcaacgggggtggtctgcacattctactgcacactgggtggtcttaaagcagttatctggacagatgtttttcaagttgggatcatggtggctggatttgcatccgtgattatacaggctgtggtgatgcaaggtggaatcagcactattttaaatgatgcctatgatggtggaagattaaatttctggaattttaatcctaaccctttgcaaagacacaccttctggacaattattataggagggaccttcacatggaccagcatctacggtgtcaaccaatcccaggtgcagagatatatttcttgtaaaagcagattccaggcaaaactgtctctctacatcaatcttgtgggactctgggcaatcctcacatgctcagtgttttgtgggctcgccctatattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgatgacaaccacagaaatgccatttactactagtgtttttcaaatatacaatgttcaaaggactccactgatggataactggtattctttatcatatctgtacttcagcactgttggaactttggtaacattattagtggggatacttgtcagtttatcaacaggaggaagaaaacagaacttagaccccagatacatactaaccaaagaggactttttatccaattttgatatttttaagaaaaagaagcatgttttgagctataaatcacatccagtggaagatggtggaactgataatcctgctttcaaccacattgaattgaactcagatcagagtggcaagagcaatgggactcgtttgtgaagctgctctgatactagatatccttaaatgatgtttcaattttatatgttttctaagataattggatcaggttttctttgtgtgtgtgtgtgtgttgtatcatgagtgtttgggggataagtttttgttaaaacaaagtctggactatcttcatttactacatcattaattgatgttactctggagtttagaattctggcattgacatttccctctctttcctttatttcgatgaagctataattgtgaaaattgtaactacatagatgctgaaaggctaatacacacatatgcacatgtatttgattgtcaaaggtatattcttaaatttgggtattattgaaaatattttccatgccttggtgctagcatataagtttggaagtttgccaacatcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttattttctgatacgtgttatttaggtaatcatgccctgtacatttagaggttgctaactgacaatgttaagaaattttaaaaaaaaaaaaaagcctgggcatgatggctcatgcttgtaatctgaacatttgggaggctgaggcaggaagatcgcttgaggtccagagtttaagtccagcctggaaacatagttagacctcatctctacaaaaataaaaaataaaaataaaaaaaacttagctaggcatgttgccacatacttgtagtcccagttattagggaagctgaggtgggaggatagcttaagcccaggatttcaaggctgcattgagctatgattacaccactgcactccagcctgggtaacagagtgaaatcttgtctctgggaaaaaaaa

SEQ ID NO: 184422 - DNA, 3231 bp, Homo sapiens
  Payload ID: 16314
  Gene Symbol: SLC5A6
  Gene Name: solute carrier family 5 (sodium/multivitamin and iodide cotransporter), member 6
  Uniprot ID: Q9Y289
  ENST ID: ENST00000310574
  CDS Start-End: 475-2382
gcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggctccagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccgggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 184423 - DNA, 732 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000401463
  CDS Start-End: 291-732
gtgggtctgagatcttaagtgcgagcggtaaggtggtggtctccgccgcgtagagggaagcgggaaaccgagaaagaacgagggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtga

SEQ ID NO: 184424 - DNA, 2230 bp, Homo sapiens
  Payload ID: 16314
  Gene Symbol: SLC5A6
  Gene Name: solute carrier family 5 (sodium/multivitamin and iodide cotransporter), member 6
  Uniprot ID: Q9Y289
  ENST ID: ENST00000408041
  CDS Start-End: 323-2230
tccgccgcgtagagggaagcgggaaaccgagaaagaacgagggaaaagggagcgatgttgatctcaggaagcacaaagggaccttcctagctctgactgaaccacggagctactcatagagccagatcctcagctctgcagctccaggcaactctgcctcagaacagggattgcttctccagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggctccagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtga

SEQ ID NO: 184425 - DNA, 599 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000430186
  CDS Start-End: 484-599
atatggcgttcgtgcgtagagagattacacaagaggcagaggacccgtctgtagaaagaacttaaagttattctaaaattaaggggcgaaatcaagtttcacaggtctttgaaagtcggcaggactggggcgccgaaggcctgcacgactgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctc

SEQ ID NO: 184426 - DNA, 676 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000426119
  CDS Start-End: 330-676
gagcgtgagccggtgccgagaggcaccggggagcggcgtctgagccggggcggggacaagggggcggggaggggcggagcgagccggcctccggcgtgggtctgagatcttaagtgcgagcggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacat

SEQ ID NO: 184427 - DNA, 570 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000428518
  CDS Start-End: 395-570
acgcacggctggccagcgaccctgcttcagcccgacctcaaacttgcttctgtacctcggtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagct

SEQ ID NO: 184428 - DNA, 917 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000412471
  CDS Start-End: 339-917
atccgccctcagtaaacatggcggcacggcgagcggggcgggcagggggcgggcagggggcggggcccccgcgggctcccggccagggctctcggccgggctctggctacccacgtgtggagaccgggcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctg

SEQ ID NO: 184429 - DNA, 741 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000414408
  CDS Start-End: 506-741
gtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagccgctcttcctgcgtctgctgttgactgtgatgttgcaggtagaggggctgagagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccacctt

SEQ ID NO: 184430 - DNA, 871 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000445802
  CDS Start-End: 247-708
cggccgggctctggctacccacgtgtggagaccgggcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatgtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtggg

SEQ ID NO: 184431 - DNA, 725 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000432106
  CDS Start-End: 327-725
atatcgcacagggaaggtcctcatctctgaagatcactattcgaacttatttattatgctttctgcagagacttctcaatctgacagccctagtttggcgcggtgtaaaacgaccgcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctg

SEQ ID NO: 184432 - DNA, 542 bp, Homo sapiens
  Payload ID: 16314
  Gene Symbol: SLC5A6
  Gene Name: solute carrier family 5 (sodium/multivitamin and iodide cotransporter), member 6
  ENST ID: ENST00000442731
  CDS Start-End: 462-542
agtaccagatatcgcacagggaaggtcctcatctctgaagatcactattcgaacttatttattatgctttctgcagagacttctcaatctgacagccctagtttggcgcggtgtaaaacgaccgcagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatg

SEQ ID NO: 184433 - DNA, 11574 bp, Homo sapiens
  Payload ID: 16315
  Gene Symbol: SLC5A3
  Gene Name: solute carrier family 5 (sodium/myo-inositol cotransporter), member 3
  Uniprot ID: P53794
  ENST ID: ENST00000381151
  CDS Start-End: 513-2669
cggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtagcaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccatacaaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaatttttttttctgtctctgtaatccctcctaccattaagaaaaacttatttcttagacattgtacaatcagttatgtactgaaaatcgaatgtgcttgtgtgatacttgtttcaggacaagttcatttgccaggttcattttgttagcatgagcctacggattctgatttcccaaagaaagaatgttttcctgtaggtatttttgtaccaccagtatatggaatgttagggaaaaactttgttccagttcctttttttttttctttctactttcaagtttaagtgaaccatactgaaatgaccaacaagtctgcctgtaaagttacatgtcatgattgtgttgttaaatgattatgggggagaaaatgaagtaaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagactttccatctgtacacagcctctacatttttgttgtagtgacttagagcataaggatgtttcagtgcaaactggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctgtcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaattta

SEQ ID NO: 184434 - DNA, 4436 bp, Homo sapiens
  Payload ID: 16316
  Gene Symbol: SLC5A10
  Gene Name: solute carrier family 5 (sodium/sugar cotransporter), member 10
  Uniprot ID: A0PJK1
  ENST ID: ENST00000317977
  CDS Start-End: 572-2272
tggcaaaaatcccaaggacttttgatccaaaggcggcagttatcactaagtggtttatttccttctaagacctagccaacggtctcagagccaatgctgctggtacaactactctattaatgggatagttttggtaagtctggatcctcccagctgggtcctcctgatcagtgcaaagcagccttttgttttaaaacacattgcaagcaatggcttgggaagtaaacaccatctgaggctcgctggccagaggcaaggggagacggcaggcagttgagcctgcctgagggttctctcagcagtgacttcctttttcccttccttcttctgcctagtcctgtatgtgaggactattaattgttttttgttgttgttgttgtttgttttgtgagatggagtctccctctgttgcccaggctggactgcaatggcgcagtcttggctcactgcaatctctacctcctgagttcaagcaattctcctgcctcagcctcccaagtagctgggattacagtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacgcactgggataccctcaacacccccagcccctcaaagccgtctcagcttcctcctgcccgaaacaccaccattggagcggtatctcctaggcctcgtggtcatggatctctggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctgatgttggttttactgttttcgttttgaatacacaggctgggtcaggagcagtgagatttgccagcactcagggttctaagggtcttgggccagctctggatggaggaagagccccacatgcccagagcaaggccccccattaagggactgcagccacctccaagggctcctccctccacccaccggctcccaaatgccagagggagcctcttcgccctccctccctgcccaccatccctcaaccatcagcctggcgttcaaagcctttccaagtcccacctcacttttccctctcccaaaggtgcccaggctctgggcaggccctgctcatatccctgatcatggcacattctctggaggaccctcctgttctcgggtaggggccgtgccccacctaggtagccgtcccatgtgggatcctgtaggatctctaaaacctagctctggccccaactttctgtctgccctggaggtttctcagcctcctgagagctctgctgggccccggtctgggcagaacctgggcctaaacaaacaagagccagggcagccagggtctctgcgtggctgggcccagggcttgccctcagagctcacctgtccaacagaagaggagtgtgcctccaccttccctactgcccgcccctttttcagggtcttagggcctctagccctgtggtggggtgctgggtgccccaggtggagctgaagtcatggggctgttgaggagttggtgtccacctggagtctgtccagtgagtttaggtcaacaggtgtgcagtctgtccttcgaggctgagccacctcccaacagcctgaacaactccaggggccttttgagggaggggcaggcaggcccagtgggtggtcagcccaaggtgaacccacccaccatggccagggttccttaggttgagcctccagtgggtgaaacctgggagtcctcaaccttcctggcagatggggccattgacaagaggaggtgggcggggcctccacagactccgccctgtggtgtcacacagctggcagccaatggaaagcaaccagccaggaagccccggagctacccttgctgggtacccttgctgggggacctgggccatcccagtttgtgcagagcggccggaggcagttaggagcccacgttcagtccaaggccgtccactgagccccgtgtgactctgacagagctgggggtgtccatgtcctctctggacctcagttcctgtaaaaaggcccgttggccagatcggccgccgggctgctcacaggtgcacgggctgcacgtaactccgtgggaagaagccaacgcgcccgcaggaccggccccgccaccagtgggggtctgggcgctccaggacctcaatgatgtcgccacggcggaagctgagctgcgaggggtcctgggctgagaagtcaaactgggcctgggcaaagcaggccccaggtgactgcaagaagaggaggtggttagtagggtgccttcagaagccctgcaacccaccctccctcagaggcacccaagagaagtgatttgccacaggtgaggaggggtctcgggcagcaccggagttgaactttaagtccagatcaatggtagtgccaccactgggcctcctgctgcccacacccctgcctgtctgctgtgcagatgctgcatctacatagaacacggctttcccagccgcccagctgggacaatagggctggtgggtcaggggacctgagtcctggtccttagggtgggattttggttaggtccctgcttctcttgggatcttatttacccgactctgcagcagccatggtagcttttgactccaggccacaaagccatgagaatgggccttataaactgtaaagtgacgtgcagctaagagtcgtgtttattgctcttgccct

SEQ ID NO: 184435 - DNA, 1982 bp, Homo sapiens
  Payload ID: 16316
  Gene Symbol: SLC5A10
  Gene Name: solute carrier family 5 (sodium/sugar cotransporter), member 10
  Uniprot ID: A0PJK1
  ENST ID: ENST00000395643
  CDS Start-End: 19-1728
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggaca

SEQ ID NO: 184436 - DNA, 2069 bp, Homo sapiens
  Payload ID: 16316
  Gene Symbol: SLC5A10
  Gene Name: solute carrier family 5 (sodium/sugar cotransporter), member 10
  Uniprot ID: A0PJK1
  ENST ID: ENST00000395645
  CDS Start-End: 19-1809
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 184437 - DNA, 2140 bp, Homo sapiens
  Payload ID: 16316
  Gene Symbol: SLC5A10
  Gene Name: solute carrier family 5 (sodium/sugar cotransporter), member 10
  Uniprot ID: A0PJK1
  ENST ID: ENST00000395647
  CDS Start-End: 42-1880
agtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 184438 - DNA, 1984 bp, Homo sapiens
  Payload ID: 16316
  Gene Symbol: SLC5A10
  Gene Name: solute carrier family 5 (sodium/sugar cotransporter), member 10
  Uniprot ID: A0PJK1
  ENST ID: ENST00000417251
  CDS Start-End: 42-1724
agtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 184439 - DNA, 3272 bp, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENST ID: ENST00000236495
  CDS Start-End: 51-2171
gaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggtcaggtcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagtt

SEQ ID NO: 184440 - DNA, 1046 bp, Homo sapiens
  Payload ID: 16317
  Gene Symbol: SLC5A9
  Gene Name: solute carrier family 5 (sodium/sugar cotransporter), member 9
  ENST ID: ENST00000441260
  CDS Start-End: 1-520
gagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgggatcctgctggtggtgactgccgtctacaccattgcaggtggcctcatggccgtgatctacacagatgctctgcagacggtgatcatggtagggggagccctggtcctcatgtttctgggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatca

SEQ ID NO: 184441 - DNA, 3195 bp, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENST ID: ENST00000438567
  CDS Start-End: 53-2098
atgaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaatt

SEQ ID NO: 184442 - DNA, 1950 bp, Homo sapiens
  Payload ID: 16317
  Gene Symbol: SLC5A9
  Gene Name: solute carrier family 5 (sodium/sugar cotransporter), member 9
  ENST ID: ENST00000425816
  CDS Start-End: 53-904
atgaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccac

SEQ ID NO: 184443 - DNA, 968 bp, Homo sapiens
  Payload ID: 16317
  Gene Symbol: SLC5A9
  Gene Name: solute carrier family 5 (sodium/sugar cotransporter), member 9
  ENST ID: ENST00000532322
  CDS Start-End: 1-229
atacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacaggtgcccattatttttggcttcacttttacaacatcctccaggctggacccctttcaattcactccaagagaactttgaagatcctggcacttacagtctatctgctgcttaaagtctgcagtgactctccattgcctacagggtttttgttctttaagctacgactcctcagcctgacctttgaagacttgttctcaagtgcctgcctccctgtccagcctcatttgcctcagtctgtaaaatccatgaggacagggcccaggtgtgtttcagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacaga

SEQ ID NO: 184444 - DNA, 2219 bp, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENST ID: ENST00000533824
  CDS Start-End: 53-2161
atgaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccac

SEQ ID NO: 184445 - DNA, 1137 bp, Homo sapiens
  Payload ID: 16318
  Gene Symbol: SLC50A1
  Gene Name: solute carrier family 50 (sugar efflux transporter), member 1
  Uniprot ID: Q9BRV3
  ENST ID: ENST00000303343
  CDS Start-End: 63-566
gtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaaggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgc

SEQ ID NO: 184446 - DNA, 1166 bp, Homo sapiens
  Payload ID: 16318
  Gene Symbol: SLC50A1
  Gene Name: solute carrier family 50 (sugar efflux transporter), member 1
  Uniprot ID: Q9BRV3
  ENST ID: ENST00000368401
  CDS Start-End: 96-596
cggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctg

SEQ ID NO: 184447 - DNA, 1300 bp, Homo sapiens
  Payload ID: 16318
  Gene Symbol: SLC50A1
  Gene Name: solute carrier family 50 (sugar efflux transporter), member 1
  Uniprot ID: Q9BRV3
  ENST ID: ENST00000368404
  CDS Start-End: 63-728
gtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgcc

SEQ ID NO: 184448 - DNA, 886 bp, Homo sapiens
  Payload ID: 16318
  Gene Symbol: SLC50A1
  Gene Name: solute carrier family 50 (sugar efflux transporter), member 1
  ENST ID: ENST00000484157
  CDS Start-End: 329-799
cgagagggagggcaaaagaggaaggcttggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagagctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcc

SEQ ID NO: 184449 - DNA, 1245 bp, Homo sapiens
  Payload ID: 16318
  Gene Symbol: SLC50A1
  Gene Name: solute carrier family 50 (sugar efflux transporter), member 1
  ENST ID: ENST00000622581
  CDS Start-End: 142-669
cgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttgcaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgcccacg

SEQ ID NO: 184450 - DNA, 1463 bp, Homo sapiens
  Payload ID: 16319
  Gene Symbol: SLC51A
  Gene Name: solute carrier family 51, alpha subunit
  Uniprot ID: Q86UW1
  ENST ID: ENST00000296327
  CDS Start-End: 210-1232
agaggatcaaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtacacagcagatcttctggaggtgctgaagaccaattacggcatcccctccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgtttctcgtccccgacggcatctatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaa

SEQ ID NO: 184451 - DNA, 568 bp, Homo sapiens
  Payload ID: 16319
  Gene Symbol: SLC51A
  Gene Name: solute carrier family 51, alpha subunit
  ENST ID: ENST00000442203
  CDS Start-End: 180-356
gagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtacacagcagatcttctggaggtgctgaagaccaattacggcatcccctccgcctgcttctctcagcctcccacagcagcccaactcctgagagacagagtctggctctgtggcccaggctggagtgcagtggtgtgatctcagctcaatgcaacctccacctcccagttcaagcaattctcctgcctcagcctctccagtaggtgggattacagcaacggtgaggccagatgaggtctaccagtatttgtcaaagtgtctgctatcctccgaccactatcagccctgggccctgtggaacttgccctcactagcatcctgaccttgctggcgctgggctccattgccat

SEQ ID NO: 184452 - DNA, 572 bp, Homo sapiens
  Payload ID: 16319
  Gene Symbol: SLC51A
  Gene Name: solute carrier family 51, alpha subunit
  ENST ID: ENST00000416660
  CDS Start-End: 374-572
agccctgctctagctgcctccggtgacaggcacttccaacagcaaaccccacccccaccccgacatgtgctggggaaccgggagttcctgcccctgagaggctgatgttgttggagaaaatatgacctggagaaacacatgggaagaaagttctttaggctccgataaaaattgacacgaggccaagcaaatttcccagacaaggctttattaggggcttccgttccaccacgggggagacagcaccgcagggagaggtctccggctggctccccaggggactgcgttgtggcgtctcgaggagggcgacacgcgtaattcatgaggtcgtgtgatcagtggatgtggcattttgtgtaagatttacagtggaatgctgcttatcttaatgctttcactgtccttcaatgagcaggcaagccaccctgcccccggcccccacctgcccgccccgcctgcccttcctcaccccggtgcctgcgggattgctggagagaacgcggcgatggagccgggcaggacccagataaagcttgaccccaggtacacagcagatcttctggaggtgctga

SEQ ID NO: 184453 - DNA, 742 bp, Homo sapiens
  Payload ID: 16319
  Gene Symbol: SLC51A
  Gene Name: solute carrier family 51, alpha subunit
  ENST ID: ENST00000415111
  CDS Start-End: 1-72
caagccaggctacacctgggtgagcagaacatgggagccaaatttgctctgttccagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaa

SEQ ID NO: 184454 - DNA, 636 bp, Homo sapiens
  Payload ID: 16319
  Gene Symbol: SLC51A
  Gene Name: solute carrier family 51, alpha subunit
  ENST ID: ENST00000428985
  CDS Start-End: 1-636
ccgcctgcttctctcagcctcccacagcagcccaactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacgctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggaagaagcttcagctgctgatgttgggccctttccaatacgccttcttgaagataacgctgaccctggtgggcctgt

SEQ ID NO: 184455 - DNA, 940 bp, Homo sapiens
  Payload ID: 16320
  Gene Symbol: SLC51B
  Gene Name: solute carrier family 51, beta subunit
  Uniprot ID: Q86UW2
  ENST ID: ENST00000334287
  CDS Start-End: 322-708
cctgggcgtgtgctaaggccagagctaccagatgggtccagctgccgcaggctctccaggcactgtcccctaagtgacagctgttactgcctgggagagctcaagtgcaaagactatcctgttctcccataaagaggaggaaaaggaagatacagaaatcggtgctgctcccaacagcagatcaaggcagtcgtcaggaactcaggatccggggggtcttcacggcttctctgcccaggggccagaaccgaggaggccaggagggctgctggggctaaggggtctaaggacctcgttgcacacgctaccaggagcaggggcatggagcacagtgagggggctcccggagacccagccggtactgtggtaccccaggagctgctggaagagatgctttggttttttcgtgtggaagatgcatctccctggaatcattccatccttgccctggcagctgtggtggtcattataagcatggtcctcctgggaagaagcatccaggcaagcagaaaagaaaagatgcagccaccagaaaaagaaactccagaagtcctgcatttggatgaggccaaggatcacaacagcctaaacaacctaagagaaactttgctctcagaaaagccaaacttggcccaggtggaacttgagttaaaagagagagatgtgctgtcagttttccttccggatgtaccagaaactgagagctagtgagggttcagagaagccccatcctaagccagacacatgatgtgggctcagctcagtggcctgaaacctctcaggttttagagtctctcccaagaagccgcttttttctttttctttctttctttttttttttcttagcagatacaatgaatgaactgcaagcaaactaaaattctgttattaaaaaaaatcttttattaaaatgctcctggaagggagcaggtggtattgc

SEQ ID NO: 184456 - DNA, 2377 bp, Homo sapiens
  Payload ID: 16321
  Gene Symbol: SLC52A1
  Gene Name: solute carrier family 52 (riboflavin transporter), member 1
  Uniprot ID: Q9NWF4
  ENST ID: ENST00000254853
  CDS Start-End: 674-2020
gcaaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgatctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacatata

SEQ ID NO: 184457 - DNA, 2412 bp, Homo sapiens
  Payload ID: 16321
  Gene Symbol: SLC52A1
  Gene Name: solute carrier family 52 (riboflavin transporter), member 1
  Uniprot ID: Q9NWF4
  ENST ID: ENST00000424747
  CDS Start-End: 714-2060
agtgtcgcaaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgatctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgcctattacctgccagcctgtctgtttccctccagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatac

SEQ ID NO: 184458 - DNA, 2989 bp, Homo sapiens
  Payload ID: 16321
  Gene Symbol: SLC52A1
  Gene Name: solute carrier family 52 (riboflavin transporter), member 1
  ENST ID: ENST00000512825
  CDS Start-End: 1413-2465
tcggcctcccaaagtgctgggattacaggcctgagccacggtgcctggcctatctttcattttcaaagcttgtttttgagtggtggcatggggcacacccctgtactgctaatgcaaaggaatattagaatcaccatttgtgaaagaaacttggcagtctgttacaagagcctcagctatgtcatacagtttcacccaataattctatttcaagagacttatccaggaaaaaaaaaaaaaaaaagaccaaaataagaaaagctttgtaatgagcccttgttgcttttacctacccagtgcctctgttcctcttctggtaactgaattcctccttcatctaccaatttatagcagcagggtttgagattctttcactgaattccaaccaatcaaattatctgaaaagtattatttttcttttttcagacagggtctcgctctttcacccaggctggagcacggtggtgtgaccccagttcactgaagcctcaacctcctgggctcaagggatcctcccacctcagcctcctgagtagctgggactataggtgcacatcagcatgcccaactaaattttattttttgtagagatggggtttcgccatgttgcttgggctggtctcgaactcctgggctcctgcgatccgcccatctcagcctcccagagtgctgggactacaggcatgggccattgcacctggcctttaaaatattcttttcttttcaagtgagaaatggtatcctactgatgtcttaatttgcctttctttgatatatacagtcagggagagcatcttttccacatgtctattggccatgtgtatttcccatgaaatatttcataccacccccctcaccattttacaatatgatctttatcaatgtcacagtgataggatatgtctctaacctgtatcttttattttctttctttccttttttttttttttgatacggagttttcctcttgtcgtccagtctggaatgcaatgacatgatctcggctcaccacaatctccgcctcccgggttcaagcaattctcctgcctcagcctcccgagtagctgggattacaggcatgtgccaccatgcccggctaattttgtatttttagtagagacagggtttcgccatgttggtcaggctggtctcgaactcctgacctcaggtgatccacgcccccttagcgtcccaaagtgctgggattacaggcacgaactactatgcctgggattaacctgtatcttttgacttattaacttgtctgtgcttactggagtggcactctgagctgagcctggacagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcagctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacat

SEQ ID NO: 184459 - DNA, 1896 bp, Homo sapiens
  Payload ID: 16322
  Gene Symbol: SLC52A2
  Gene Name: solute carrier family 52 (riboflavin transporter), member 2
  Uniprot ID: Q9HAB3
  ENST ID: ENST00000329994
  CDS Start-End: 302-1639
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaa

SEQ ID NO: 184460 - DNA, 1777 bp, Homo sapiens
  Payload ID: 16322
  Gene Symbol: SLC52A2
  Gene Name: solute carrier family 52 (riboflavin transporter), member 2
  Uniprot ID: Q9HAB3
  ENST ID: ENST00000402965
  CDS Start-End: 185-1522
atgccgggggcgggcccggaaccgccacgggtgagtcgggtcgtggctgctgccgggtcctgcgcgctccggactgagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 184461 - DNA, 935 bp, Homo sapiens
  Payload ID: 16322
  Gene Symbol: SLC52A2
  Gene Name: solute carrier family 52 (riboflavin transporter), member 2
  ENST ID: ENST00000534725
  CDS Start-End: 419-935
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcc

SEQ ID NO: 184462 - DNA, 655 bp, Homo sapiens
  Payload ID: 16322
  Gene Symbol: SLC52A2
  Gene Name: solute carrier family 52 (riboflavin transporter), member 2
  ENST ID: ENST00000526338
  CDS Start-End: 145-655
ggccatgccgggggcgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagaggctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggt

SEQ ID NO: 184463 - DNA, 710 bp, Homo sapiens
  Payload ID: 16322
  Gene Symbol: SLC52A2
  Gene Name: solute carrier family 52 (riboflavin transporter), member 2
  ENST ID: ENST00000526752
  CDS Start-End: 112-447
gctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattta

SEQ ID NO: 184464 - DNA, 495 bp, Homo sapiens
  Payload ID: 16322
  Gene Symbol: SLC52A2
  Gene Name: solute carrier family 52 (riboflavin transporter), member 2
  ENST ID: ENST00000524541
  CDS Start-End: 288-495
ctcttgcttctgcacctgcgggcgccacgcggagagtctgagcggcgcggggccggccctcaggggaggagggcggtgggggtcgggcccaggggctcacacctctctcagggagctgaagctgaccaggaccacgctgatgatgaagagcagcatccccttccacagtgtgtccagctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggagga

SEQ ID NO: 184465 - DNA, 1790 bp, Homo sapiens
  Payload ID: 16322
  Gene Symbol: SLC52A2
  Gene Name: solute carrier family 52 (riboflavin transporter), member 2
  Uniprot ID: Q9HAB3
  ENST ID: ENST00000527078
  CDS Start-End: 447-1784
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgg

SEQ ID NO: 184466 - DNA, 1757 bp, Homo sapiens
  Payload ID: 16322
  Gene Symbol: SLC52A2
  Gene Name: solute carrier family 52 (riboflavin transporter), member 2
  Uniprot ID: Q9HAB3
  ENST ID: ENST00000530047
  CDS Start-End: 165-1502
gggcgggacttccggtcgtgggccatgccgggggcgggcccggaaccgccacggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtattt

SEQ ID NO: 184467 - DNA, 2147 bp, Homo sapiens
  Payload ID: 16322
  Gene Symbol: SLC52A2
  Gene Name: solute carrier family 52 (riboflavin transporter), member 2
  Uniprot ID: Q9HAB3
  ENST ID: ENST00000532887
  CDS Start-End: 584-1921
ggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacat

SEQ ID NO: 184468 - DNA, 881 bp, Homo sapiens
  Payload ID: 16322
  Gene Symbol: SLC52A2
  Gene Name: solute carrier family 52 (riboflavin transporter), member 2
  ENST ID: ENST00000526779
  CDS Start-End: 165-428
ccgcagcgactcgggccggcttcctgcttccctgcctgccggcggtcccgctggctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgagcacagggggac

SEQ ID NO: 184469 - DNA, 2654 bp, Homo sapiens
  Payload ID: 16323
  Gene Symbol: SLC52A3
  Gene Name: solute carrier family 52 (riboflavin transporter), member 3
  Uniprot ID: Q9NQ40
  ENST ID: ENST00000217254
  CDS Start-End: 299-1708
atacaaaacgagctgcctctggcccctcccatgcagagcggctggggaactggaccagcagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagccgggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgctttta

SEQ ID NO: 184470 - DNA, 3060 bp, Homo sapiens
  Payload ID: 16323
  Gene Symbol: SLC52A3
  Gene Name: solute carrier family 52 (riboflavin transporter), member 3
  Uniprot ID: Q9NQ40
  ENST ID: ENST00000381944
  CDS Start-End: 243-1490
actagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtgagtatccggccggtggggctgctcccgctgcgtacccctcacccctagccaaggcctgggagagcttgggcgcggccctttccagcgagcggggtctgtgggaccctcccgggaagccccaggtgggggaagcgccccttcctcatttgggagtggaggcttagggaatcgaggtgactggtaggcctcttcccaccatgtgtacctcagcaggggccttctctcaagggcccttgccctgatcatgggcacgtgaacccagaaaagccactggattctccttcgcccccgggcggccaactcatgggacccgtcggccccgcaggctcactcccagaaggcgctcctcgcacctagagagtattccgtgggttcccctgagccctgtgagagttctttgctccggcgctcgccccgcaagccccgtgactctgcacctcttccctcccggccccgcaggtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagccgggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgctttta

SEQ ID NO: 184471 - DNA, 2694 bp, Homo sapiens
  Payload ID: 16323
  Gene Symbol: SLC52A3
  Gene Name: solute carrier family 52 (riboflavin transporter), member 3
  Uniprot ID: Q9NQ40
  ENST ID: ENST00000632431
  CDS Start-End: 340-1749
gtgagggaattccgtgtgtgggaaccgtggggaggagctgccaggattcaggagtttcctgggtgaggcgtggccacaacggacactcctgctttgtactagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagccgggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgctttt

SEQ ID NO: 184472 - DNA, 4520 bp, Homo sapiens
  Payload ID: 16324
  Gene Symbol: SLC6A14
  Gene Name: solute carrier family 6 (amino acid transporter), member 14
  Uniprot ID: Q9UN76
  ENST ID: ENST00000598581
  CDS Start-End: 89-2017
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggattccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacttcgtgcatttgttacagctcatgttttctatatgaacttagtcattaatgttctttataaaaagtgaaataagatggaaaaataaggatcctacagccagtaagtgataaatctagaaaattgagttttgagtacctcttttcccatatacaatcttccttccttaggtaatttggaagaaaactatgacccatttaatttctattgtgtttcacaaaattaagtgttgttcattatactctctgaaatataggtttaatttcaaatagaatatggacttaaatgttaatgagaaaatggctttaatcaattctagcattttattactgtaatacagggctgatagagtgattttgtcttatatgagtaagttactacttacaggtgataacttgcatactattggaagataaacttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacactgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttccttttttttttttttggtggggggctgggggtcagagtcttgttctgttgcccgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctcaa

SEQ ID NO: 184473 - DNA, 4502 bp, Homo sapiens
  Payload ID: 16325
  Gene Symbol: SLC6A1
  Gene Name: solute carrier family 6 (neurotransmitter transporter), member 1
  Uniprot ID: P30531
  ENST ID: ENST00000287766
  CDS Start-End: 422-2221
tcccttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggatctcacccagggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaatccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaa

SEQ ID NO: 184474 - DNA, 472 bp, Homo sapiens
  Payload ID: 16325
  Gene Symbol: SLC6A1
  Gene Name: solute carrier family 6 (neurotransmitter transporter), member 1
  ENST ID: ENST00000425938
  CDS Start-End: 357-472
ttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggatctcacccagggtggcagaaggaggccttctggagctgacccacccccgacgaccatcagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggc

SEQ ID NO: 184475 - DNA, 4296 bp, Homo sapiens
  Payload ID: 16326
  Gene Symbol: SLC6A11
  Gene Name: solute carrier family 6 (neurotransmitter transporter), member 11
  Uniprot ID: P48066
  ENST ID: ENST00000254488
  CDS Start-End: 67-1965
gaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagcaccgggtcctggccatctctgacgggatcgagcacatcgggaaccttcgctgggagctggccttgtgtctcttggcagcctggaccatctgttacttctgtatctggaaggggaccaagtctacaggaaaggttgtatacgtgactgcgacattcccctacatcatgctgctgatcctcctgatacgaggggtcacgttgcccggggcctcagagggcatcaagttctacttgtaccctgacctctcccggctctccgacccccaggtctgggtagatgctggaacgcagatctttttctcctatgccatttgcctgggctgtctgaccgctctgggaagttataacaattataacaacaactgctacagggactgcatcatgctctgttgcctgaacagcggcaccagcttcgtggctgggtttgccatcttctcagtcctgggttttatggcgtacgagcagggggtacccattgctgaggtggcagagtcaggccccggcctggcctttattgcgtaccccaaggcggtcaccatgatgcctctctccccgctgtgggccaccttgttcttcatgatgctcatcttcctgggcctggacagccagtttgtgtgtgtggaaagcctggtgaccgccgtggtggacatgtaccccaaggttttccggaggggttaccggcgggagctgctcatcctagccttgtctgttatctcctattttctgggcctcgtgatgttaacagagggtggcatgtacatcttccagctctttgactcctatgccgccagtgggatgtgccttctcttcgtggccatctttgagtgcatctgcatcggctgggtgtatggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacactgcccgagaaactccagaagttgacgacccccagcacagatctgaaaatgcggggcaagcttggggtgagcccacggatggtgacagttaatgactgtgatgccaaactcaagagtgacgggaccatcgcagccatcacagagaaggagacgcacttctgagcggccaccagccatctggggctcttcttcctttcttccccccgtgtatgtaaatgaattcctgaaccccatacttcacctaatggtaggggcttgcttgttttgcacaggattaattaacaagttaattttaaggtggccactgtacactgctctaaagtcatatcccctccccgcccccagtcatcatggaagtaaccactacaaagagataacactgtacggggactgccagatcttctgtcctagggcagttttaatcaatgttttctagggattaggaagaagtgtataatattgtaaaactttttttactggggttgtgggccaggtggggtggggagtgatggctgtcctcctctgtcggccttttaatgaccgttctgtgtcccatgtatgtctctgaccatccacagccgcccctcctccataccccagggataatttttccttcaaaccttccctttccaagggacactgggtttgcagacagcaaggctatgtggcagagaagaaaaagtccagcagactcaggactcctgggctgcaggcccccctctgccctgatcccatgaagtgaccttgggcactccctttccctccctgggcctcagtttccccatctcccaaatgggaggaggagccggattgggttatttcttagggattctctttgtgtgccttgctggcttccagacctgccgtggaccttggcttcctctgaagacttgcaggcaataatctccgccctcccagttgtacctcctccccacctgcttatttaaaatcaagtttattgtagaaatggtgtggtgttgatgtgtgttttccctaaaactctaatttcatctcatctgtgggcagccctgctctctggacaccagtgggtcctcagcccccatggcaggggctcctctgtctggcctgcctttttttcctggtcagctgctcttagcgccggctctgcctctccacccttggcagggctggctggagttgctgtggggactgattttctgggtggggaagcagccatctattcttgcagccatctcagccagggtctatgtcttaggaccttcctccggccttccatgagaagcagccacagggggcctggtttcctcctaaggcccttctctgtcccaggccacctcttctccctcctcctgtcccctaacctccacctaccaccatcctccctctcagttctctcccatccttgcccctggttcaggagccattctacctgcctcagtggccaggcgcaaggctacaggtgcagtcacctgttcccggccaccttccctcccatctttggcagacagaagtctcagctctcactagagggaagacctgggcatcctgctggctcctctctccgtggggcctggagtctggtgctgttccccagccagcctggctgcagacctctctggctgataccgctcttcttctttaattggacttcatatcaagcctctgccttggtttctgagctatatgagggtggggaaggcacactcttttttcctttttccttaggttcccaatattatttggtggaaacgtgggctttctccaaaccaaggcctgagtttcctgtaagggtcctctgtttttgattcacccaaaagtctgcaaacccccagcatctctgctctggccagccctgatctgaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccattgctgctgctaccggttctccacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatcctttctgagatatttacagtattattaaaaaatgaaaaaggttgtactgttttgcataatgaacatttttattgggcattcaaagggtgcaagattgtctgcttactcatttttaaaaattaaagaaatgaacaatcagtgtggctattcctagcaa

SEQ ID NO: 184476 - DNA, 2794 bp, Homo sapiens
  Payload ID: 16326
  Gene Symbol: SLC6A11
  Gene Name: solute carrier family 6 (neurotransmitter transporter), member 11
  Uniprot ID: P48066
  ENST ID: ENST00000454147
  CDS Start-End: 66-692
aaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagtaagtggagaagaacttgtctcccttggcctgtgggggctctgtcctggttctgctcagttggtcttgcccctattcctggaaaaagcctgatccttcttgcagcctggcacttcctggcttctgtgagcattcgacagcttcggaagcaagagtgcagatcttcagaggtttcccaaaggggcagctgagagaaatgttttcttgttctttgataacatgtcagcatgcatagtgggttattagggcaggaagtacttggtgaaaggatagacagtttaaaaattcattttgagcaaaagaggagatgcagcctgtttgcaataagctaagtcaagagtgtatttagcctggaaagcataagtctctagaggggataggttagctttctttcagtagctgaagtgtcatatggaaaagaaggagatcaaatttaatggatagagattataaagaggcaggtttcaaatgtgcgtagggaagaacttggtctcatagcatagcattatctggaagcacttcagaaggttgtgagcacccatccctggaagttgaccagtatagggttgccaatcattgttgggggtgtgtctgaatccactgaaattataagtagtacttgtgtggttgggcattttcccagaaattggcatagttttatcagagttccaaaggatctgtgacccttacagggctgctatgtgtggttgtgtacattgcacactgaacaacccaaggggccataatttacattatgaaatatacattccagaattgtgtggtgcacgacctgtataaccatacacagtggccctgacttgcaagtttgttttaaaggtagaaggatcccttgccccaggtattggaaagaagtttcctgtatgggtcaaaggctggactaaatgctttctgaagcttttcaatctaaaaagtcctggcttcattgaagaagcctcccttactctgatggtgattaatagtagtatatgtgtgtgtggtggggcagtggtttatgagtgatttttatttttttcccagataccattcgtctcctgccttctctagaggtcattatgctgaatttagatttaccactctcatataaatcttcatacttttcatatatatatgccccaaatagcacctaggtctttcttgcatatttttcaaatttgtgatactggcatccattatttacattttttataacaactttatttctttgctcaatattggttcttagatgtatccatattggtacatgtagctttggttctttcatttttctatcagagtatttcattgtatgaatggcctgtgttgtatttatccaggtcctcttggtcctcttgatgggcatttaggctgttgcccatttctcactattattaagcacactgagtgaatgtctagtctgtgcttccttgagtggaattgctgggttgtagcatacatgcgttgtcagttttatcatataacgtaaaattactttagaaagaaattaatctaggccaggcatggtggctcacacctgtaattccagcactttgggaagccgaggtgggcggatcacctgaggtcaggagtttgagaccagcctggccaacatggtgaaaccctgtctttactaaaaatacaaaaattagctgggtagtggttcatgcctgcaatctcatctactcaggaggttgaagcaggagaatcacttgaacctggaaggcgaaagttgcagtgagccgagatcggcgccactgcactccagcctgggtgacagagcgagactgtctcaaaaaaaaaaaaaaaaattaatttacactccaaacaagagtttgtgagaatttctgcagcttcacattttggacagcacttggtctgttcagtttttgttttgccagtgtaatgggcattaaatgataacttactattttaaattcacatttctctaattacttgtgaggttaagcaccttttcatgttttgttttgtctgttttttgctatttgatttctgtacctgtgaacttcaggtttacattcgtttctatttggatagtttgtcttttcttacagatagaaattgttaatacattctagatattatcttttc

SEQ ID NO: 184477 - DNA, 3165 bp, Homo sapiens
  Payload ID: 16327
  Gene Symbol: SLC6A12
  Gene Name: solute carrier family 6 (neurotransmitter transporter), member 12
  Uniprot ID: P48065
  ENST ID: ENST00000359674
  CDS Start-End: 330-2174
agtgattagcctgtggagcaggaaagtccagcgatgggcagctggtcacggcagtgggtgaaagcaggggtggtcatctgacgaggggaggggaagcaggtggtgcccagcaaggtggaaggagaagtggacaggagaaacctcggggcattcccgagggcccaggaactgcaataaatgatcacagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcg

SEQ ID NO: 184478 - DNA, 3294 bp, Homo sapiens
  Payload ID: 16327
  Gene Symbol: SLC6A12
  Gene Name: solute carrier family 6 (neurotransmitter transporter), member 12
  Uniprot ID: P48065
  ENST ID: ENST00000397296
  CDS Start-End: 459-2303
gttcagaggccccaccttctcttttcctcccaatcagctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcg

SEQ ID NO: 184479 - DNA, 3332 bp, Homo sapiens
  Payload ID: 16327
  Gene Symbol: SLC6A12
  Gene Name: solute carrier family 6 (neurotransmitter transporter), member 12
  Uniprot ID: P48065
  ENST ID: ENST00000424061
  CDS Start-End: 556-2400
gggtgtgaaggactacagagagagccaggttttggtgccatgcacacagggaaacttagagttcagagagggggtgtgatttgcctgaggtcacacagcaagttagagacccagctccacgactcattgtcttgctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccag

SEQ ID NO: 184480 - DNA, 577 bp, Homo sapiens
  Payload ID: 16327
  Gene Symbol: SLC6A12
  Gene Name: solute carrier family 6 (neurotransmitter transporter), member 12
  ENST ID: ENST00000537793
  CDS Start-End: 140-577
atccctgtttctctagagccttggaggagcgtggggcacttggtagacctggtcgctttgattccctcaatacccctcagaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagc

SEQ ID NO: 184481 - DNA, 2101 bp, Homo sapiens
  Payload ID: 16327
  Gene Symbol: SLC6A12
  Gene Name: solute carrier family 6 (neurotransmitter transporter), member 12
  Uniprot ID: P48065
  ENST ID: ENST00000536824
  CDS Start-End: 257-2101
tctttctgtctgggagtccctggacaagtcacatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtag

SEQ ID NO: 184482 - DNA, 554 bp, Homo sapiens
  Payload ID: 16327
  Gene Symbol: SLC6A12
  Gene Name: solute carrier family 6 (neurotransmitter transporter), member 12
  ENST ID: ENST00000535347
  CDS Start-End: 312-554
acatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctgg

SEQ ID NO: 184483 - DNA, 2185 bp, Homo sapiens
  Payload ID: 16328
  Gene Symbol: SLC6A13
  Gene Name: solute carrier family 6 (neurotransmitter transporter), member 13
  Uniprot ID: Q9NSD5
  ENST ID: ENST00000343164
  CDS Start-End: 54-1862
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgc

SEQ ID NO: 184484 - DNA, 1101 bp, Homo sapiens
  Payload ID: 16328
  Gene Symbol: SLC6A13
  Gene Name: solute carrier family 6 (neurotransmitter transporter), member 13
  Uniprot ID: Q9NSD5
  ENST ID: ENST00000436453
  CDS Start-End: 54-347
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgagatgagagcccttgtgccaccccacccactcctggaaggaggatacttccatctcctgcacttacggcccctctggggagtcccatagatgtatagaattctggaggtaggaggacgcttagaggtcattaaggacactctgtaagagactaagacctagaaaggttacgtgactatcccagggctctttctattataacgtggcatcgtagaaatatgagcacaagctggaaccaggtggatgagagtttggattctggctctgctacttaacactctgtgtgatcttggacaagttacttaagctctcagagcatcaattgccgctcctgcaaattgagataataatgcctgcctttcaaggtcattgtaaggattagagacaatgtgtgtaaagcacttaataaatagtagctctgctgatgatgacgttgataaccaaactgttctgtggtcttaagtaataaatagtagctctgctgatgatgacgttgataaccaaactgttctgtggtcttaagtaataagtagtagctctgttgatgatgacgttgataaccaaactgttctgtggtcttaagtaataagtagtagctctgctgatgatgacgttgataaccaaactgttctgtggtcttaagtaataaatagtagctctgctgatgatgatgttgataaccaaactgttctgtggtcttaagtaataaatagtagctctgctgatgatgacgttgataaccaaactgttctgtggtcttaagtaataaatagtagctctgctgatgatgacgttgataaccaaactgttctgtggtcttaagtaataaatagtagctctgctg

SEQ ID NO: 184485 - DNA, 1950 bp, Homo sapiens
  Payload ID: 16328
  Gene Symbol: SLC6A13
  Gene Name: solute carrier family 6 (neurotransmitter transporter), member 13
  Uniprot ID: Q9NSD5
  ENST ID: ENST00000445055
  CDS Start-End: 91-1623
cacactttaaatagccagcaccttctccttcccccttagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctgac

SEQ ID NO: 184486 - DNA, 607 bp, Homo sapiens
  Payload ID: 16328
  Gene Symbol: SLC6A13
  Gene Name: solute carrier family 6 (neurotransmitter transporter), member 13
  ENST ID: ENST00000539260
  CDS Start-End: 34-405
ctggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgaggtttccccgcaggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctggga

SEQ ID NO: 184487 - DNA, 560 bp, Homo sapiens
  Payload ID: 16328
  Gene Symbol: SLC6A13
  Gene Name: solute carrier family 6 (neurotransmitter transporter), member 13
  ENST ID: ENST00000542272
  CDS Start-End: 204-413
agataattcttctcccctgactggacctctggcagcagcttcactaaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacaggtggtgactttgcacaggacgcttacatagaaatgttagcatgccttgaagcagctgacctgaagagcacctttcctgttgccatctgatcatgcttgaggagaatgtatacccaagcatctatgtacccacatgtccaagtgtgcgggagagagtgagctgcatttgttgagaacactgtatggagttccagaagaccaacggctccctgaatggtacctctgagaatgccacct

SEQ ID NO: 184488 - DNA, 541 bp, Homo sapiens
  Payload ID: 16328
  Gene Symbol: SLC6A13
  Gene Name: solute carrier family 6 (neurotransmitter transporter), member 13
  ENST ID: ENST00000546319
  CDS Start-End: 91-541
cacactttaaatagccagcaccttctccttcccccttagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacc

SEQ ID NO: 184489 - DNA, 2858 bp, Homo sapiens
  Payload ID: 16329
  Gene Symbol: SLC6A2
  Gene Name: solute carrier family 6 (neurotransmitter transporter), member 2
  Uniprot ID: P23975
  ENST ID: ENST00000219833
  CDS Start-End: 52-1938
agcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaagaaaaccctgcatgtatccataatgatgctctcctgttaaatttacaatgaaggaaacacatcacttaactgtaagaatttcccaaaatgaactgatgaccagtgatctctctatcagagaaatgtcagatttctagcctccagaactttgatttttctggacattcaatagttcctctttctcagatatttttcaactgatgccagaaacacttggtatttgtttttaatccaacccttttgttttgaggctttggagggtaacacattttcataccctgtgagtcccaggatccacagctctgctgtggtcttagaagccactgaaacattggtgaatgtgaagtcacttttggggtgcctgccctcatccctctgtctctctgcttccgtgtaaataaagactgtttcaattgtgtcctctctgtgtcatggactgttccaatgtcatgcagatttctgtgtctgatatggattttaaaagttgttctctttgtggaatataagtgtacagaataataaataatgtttcctgggctgtgta

SEQ ID NO: 184490 - DNA, 3551 bp, Homo sapiens
  Payload ID: 16329
  Gene Symbol: SLC6A2
  Gene Name: solute carrier family 6 (neurotransmitter transporter), member 2
  Uniprot ID: P23975
  ENST ID: ENST00000379906
  CDS Start-End: 256-2109
gtcagaagtctccaactcttgagttccggcgtgccccaacctctgtttccaaatttttccagcggacgcgcgcccttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 184491 - DNA, 3201 bp, Homo sapiens
  Payload ID: 16329
  Gene Symbol: SLC6A2
  Gene Name: solute carrier family 6 (neurotransmitter transporter), member 2
  ENST ID: ENST00000414754
  CDS Start-End: 112-1797
cgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatct

SEQ ID NO: 184492 - DNA, 2268 bp, Homo sapiens
  Payload ID: 16329
  Gene Symbol: SLC6A2
  Gene Name: solute carrier family 6 (neurotransmitter transporter), member 2
  ENST ID: ENST00000561820
  CDS Start-End: 78-1892
cacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaa

SEQ ID NO: 184493 - DNA, 750 bp, Homo sapiens
  Payload ID: 16329
  Gene Symbol: SLC6A2
  Gene Name: solute carrier family 6 (neurotransmitter transporter), member 2
  ENST ID: ENST00000568655
  CDS Start-End: 151-750
gtagtgcagtgacgttaagtgtccgagaaggctcctgtggctgttgaagtgtcgcggacctgagctggggagggggtcggcacgctgccctcagcctcgagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacacc

SEQ ID NO: 184494 - DNA, 1759 bp, Homo sapiens
  Payload ID: 16329
  Gene Symbol: SLC6A2
  Gene Name: solute carrier family 6 (neurotransmitter transporter), member 2
  ENST ID: ENST00000566163
  CDS Start-End: 41-1759
gcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctga

SEQ ID NO: 184495 - DNA, 1022 bp, Homo sapiens
  Payload ID: 16329
  Gene Symbol: SLC6A2
  Gene Name: solute carrier family 6 (neurotransmitter transporter), member 2
  ENST ID: ENST00000568529
  CDS Start-End: 136-1022
cccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtatggattgatgccgcaactcagatatttttttccttgggggctggatttggagtattgattgcatttgccagttacaacaaatttgacaacaactgttacag

SEQ ID NO: 184496 - DNA, 3160 bp, Homo sapiens
  Payload ID: 16329
  Gene Symbol: SLC6A2
  Gene Name: solute carrier family 6 (neurotransmitter transporter), member 2
  Uniprot ID: P23975
  ENST ID: ENST00000567238
  CDS Start-End: 177-1715
aggttgtgtgctccttatgagaatctaactaacgcctgatgacctgaggtggaacggtttcatcttgaaactacccccaccccaaaatctgtggaaaaattgtcttccatgcgacaggtcactggtgctgaaaaggttggggaccgctgttctgcaggaaacgagagacagagggaatgggagtgcagtggtggagccacacccaaggagaggtggctgtggggctgggcctgggagactcctaccttaccccctgtccctgcccaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaagaa

SEQ ID NO: 184497 - DNA, 2471 bp, Homo sapiens
  Payload ID: 16329
  Gene Symbol: SLC6A2
  Gene Name: solute carrier family 6 (neurotransmitter transporter), member 2
  Uniprot ID: P23975
  ENST ID: ENST00000568943
  CDS Start-End: 618-2471
agtttaagtggcctgctgcggaagacagagctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctga

SEQ ID NO: 184498 - DNA, 743 bp, Homo sapiens
  Payload ID: 16329
  Gene Symbol: SLC6A2
  Gene Name: solute carrier family 6 (neurotransmitter transporter), member 2
  ENST ID: ENST00000574918
  CDS Start-End: 1-176
aagttcctcagcacgcagggctctctttgggagagactggcctatggcatcacgccagagaacgagcaccacctggtggctcagagggacatcagacagttccagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaagaaaaccctgcatgtatccataatgatgctctcctgttaaatttacaatgaaggaaacacatcacttaactgtaagaatttcccaaaatgaactgatgaccagtgatctctctatcagagaaatgtcagatttctagcctccagaactttgatttttctggacattcaatagttcctctttctcagatatttttcaactgatgcc

SEQ ID NO: 184499 - DNA, 3936 bp, Homo sapiens
  Payload ID: 16330
  Gene Symbol: SLC6A3
  Gene Name: solute carrier family 6 (neurotransmitter transporter), member 3
  Uniprot ID: Q01959
  ENST ID: ENST00000270349
  CDS Start-End: 129-1991
agcgctgcggagcgggaggggaggcttcgcggaacgctctcggcgccaggactcgcgtgcaaagcccaggcccgggcggccagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaactgc

SEQ ID NO: 184500 - DNA, 3936 bp, Homo sapiens; identical to SEQ ID NO: 184499
  Payload ID: 16330
  Gene Symbol: SLC6A3
  Gene Name: solute carrier family 6 (neurotransmitter transporter), member 3
  Uniprot ID: Q01959
  ENST ID: ENST00000621716
  CDS Start-End: 129-1991

SEQ ID NO: 184501 - DNA, 6604 bp, Homo sapiens
  Payload ID: 16331
  Gene Symbol: SLC6A4
  Gene Name: solute carrier family 6 (neurotransmitter transporter), member 4
  Uniprot ID: P31645
  ENST ID: ENST00000261707
  CDS Start-End: 577-2469
gctcctccctgcgagcgtgtgtgtgtgtcgggggtccctcccctcctggctctggggtcgggcgcgcaccccgccccgtagcgcggcccctccctggcgagcgcaaccccatccagcgggagcgcggagccgcggccgcggggaagcattaagtttattcgcctcaaagtgacgcaaaaattcttcaagagctctttggcggcggctatctagagatcagaccatgtgagggcccgcgggtacaaatacggccgcgccggcgcccctccgcacagccagcgccgccgggtgcctcgagggcgcgaggccagcccgcctgcccagcccgggaccagcctccccgcgcagcctggcaggtctcctggaggcaaggcgaccttgcttgccctctcttgcagaataacaaggggcttagccacaggagttgctggcaagtggaaagaagaacaaatgagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaactaaaaaaaaaaaatcgaaaatctctgtctgttccgcatagtatgcatttatttgacccctatttatcaatactatgatggggttttttttttttaaagaaaatttaagagtaggtaggtggattttaaaataatattttaaagaccttttatatctatatgtagcatttatagaaaaataaaaactaaaaatagaattgaattgtaacattatttaaggactgaagttttttttcttgtatcagtaagaaatacccaagaggctgggtgcagtgactcacacctgtaatcccagcactttgggaggctgcagtgggaggatcacatgacatcaggagtttgagaccagcttggccaacatagtgaaacgccgtctctattaaaaatacagaaaattagctgaatgtggtggcaggcgcctataattcctgctacttgggaggctgaggcaggagaattgcttgaacccaggaggcagaggttgcagtgagccaaacgttccactgcattccagcctggatgacaagagcgaaactccgtctcaaaaaaaaaaaaaaaaattgttatgcttagttccatggaaagactattctgaagctttaagtcttctttttctattttccatagtattgccccttccccacttcattgcttaactgtctctaaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgtttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtg

SEQ ID NO: 184502 - DNA, 2160 bp, Homo sapiens
  Payload ID: 16331
  Gene Symbol: SLC6A4
  Gene Name: solute carrier family 6 (neurotransmitter transporter), member 4
  ENST ID: ENST00000394821
  CDS Start-End: 307-2160
cacagccagcgccgccgggtgcctcgagggcgcgaggccagcccgcctgcccagcccgggaccagcctccccgcgcagcctggcaggtctcctggaggcaaggcgaccttgcttgccctctcttgcagaataacaaggggcttagccacaggagttgctggcaagtggaaagaagaacaaatgagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaaca

SEQ ID NO: 184503 - DNA, 6543 bp, Homo sapiens
  Payload ID: 16331
  Gene Symbol: SLC6A4
  Gene Name: solute carrier family 6 (neurotransmitter transporter), member 4
  Uniprot ID: P31645
  ENST ID: ENST00000401766
  CDS Start-End: 514-2406
gctcggccctgccctgccggctgctccgcgctccgctcctccctgcgagcgtgtgtgtgtgtcgggggtccctcccctcctggctctggggtcgggcgcgcaccccgccccgtagcgcggcccctccctggcgagcgcaaccccatccagcgggagcgcggagccgcggccgcggggaagcattaagtttattcgcctcaaagtgacgcaaaaattcttcaagagctctttggcggcggctatctagagatcagaccatgtgagggcccgcgggtacaaatacggccgcgccggcgcccctccgcacagccagcgccgccgggtgcctcgagggcgcgaggccagcccgcctgcccagcccgggaccagcctccccgcgcagcctggcagagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaactaaaaaaaaaaaatcgaaaatctctgtctgttccgcatagtatgcatttatttgacccctatttatcaatactatgatggggttttttttttttaaagaaaatttaagagtaggtaggtggattttaaaataatattttaaagaccttttatatctatatgtagcatttatagaaaaataaaaactaaaaatagaattgaattgtaacattatttaaggactgaagttttttttcttgtatcagtaagaaatacccaagaggctgggtgcagtgactcacacctgtaatcccagcactttgggaggctgcagtgggaggatcacatgacatcaggagtttgagaccagcttggccaacatagtgaaacgccgtctctattaaaaatacagaaaattagctgaatgtggtggcaggcgcctataattcctgctacttgggaggctgaggcaggagaattgcttgaacccaggaggcagaggttgcagtgagccaaacgttccactgcattccagcctggatgacaagagcgaaactccgtctcaaaaaaaaaaaaaaaaattgttatgcttagttccatggaaagactattctgaagctttaagtcttctttttctattttccatagtattgccccttccccacttcattgcttaactgtctctaaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgtttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtgaa

SEQ ID NO: 184504 - DNA, 1069 bp, Homo sapiens
  Payload ID: 16331
  Gene Symbol: SLC6A4
  Gene Name: solute carrier family 6 (neurotransmitter transporter), member 4
  ENST ID: ENST00000579221
  CDS Start-End: 1-217
cactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttgcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaa

SEQ ID NO: 184505 - DNA, 2356 bp, Homo sapiens
  Payload ID: 16332
  Gene Symbol: SLC6A5
  Gene Name: solute carrier family 6 (neurotransmitter transporter), member 5
  ENST ID: ENST00000298923
  CDS Start-End: 80-643
tctcctgcctgagccaaacccagtcttgtcaatagcgggtttcaccctccaccagttcagtctgttgcctgtgtcagacatggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgctgcactgtaagatcccttttctgcgaggcccggagggggatgcgaacgtgagtgtgggcaagggcaccctggagcggaacaatacccctgttgtgggctgggtgaacatgagccagagcaccgtggtgctggccacggatggaatcacgtccgtgctcccgggcagcgtggccaccgttgccacccaggtgctttcctcatcccttacctgatgatgctggctctggctggattacccatcttcttcttggaggtgtcgctgggccagtttgccagccagggaccagtgtctgtgtggaaggccatcccagctctacaaggctgtggcatcgcgatgctgatcatctctgtcctaatagccatatactacaatgtgattatttgctatacacttttctacctgtttgcctcctttgtgtctgtactaccctggggctcctgcaacaacccttggaatacgccagaatgcaaagataaaaccaaacttttattagattcctgtgttatcagtgaccatcccaaaatacagatcaagaactcgactttctgcatgaccgcttatcccaacgtgacaatggttaatttcaccagccaggccaataagacatttgtcagtggaagtgaagagtacttcaagtactttgtgctgaagatttctgcagggattgaatatcctggcgagatcaggtggccactagctctctgcctcttcctggcttgggtcattgtgtatgcatcattggctaaaggaatcaagacttcaggaaaagtggtgtacttcacggccacgttcccgtatgtcgtactcgtgatcctcctcatccgaggagtcaccctgcctggagctggagctgggatctggtacttcatcacacccaagtgggagaaactcacggatgccacggtgtggaaagatgctgccactcagattttcttctctttatctgctgcatggggaggcctgatcactctctcttcttacaacaaattccacaacaactgctacagggacactctaattgtcacctgcaccaacagtgccacaagcatctttgccggcttcgtcatcttctccgttatcggcttcatggccaatgaacgcaaagtcaacattgagaatgtggcagaccaagggccaggcattgcatttgtggtttacccggaagccttaaccaggctgcctctctctccgttctgggccatcatctttttcctgatgctcctcactcttggacttgacactatgtttgccaccatcgagaccatagtgacctccatctcagacgagtttcccaagtacctacgcacacacaagccagtgtttactctgggctgctgcatttgtttcttcatcatgggttttccaatgatcactcagggtggaatttacatgtttcagcttgtggacacctatgctgcctcctatgcccttgtcatcattgccatttttgagctcgtggggatctcttatgtgtatggcttgcaaagattctgtgaagatatagagatgatgattggattccagcctaacatcttctggaaagtctgctgggcatttgtaaccccaaccattttaacctttatcctttgcttcagcttttaccagtgggagcccatgacctatggctcttaccgctatcctaactggtccatggtgctcggatggctaatgctcgcctgttccgtcatctggatcccaattatgtttgtgataaaaatgcatctggcccctggaagatttattgagaggctgaagttggtgtgctcgccacagccggactggggcccattcttagctcaacaccgcggggagcgttacaagaacatgatcgaccccttgggaacctcttccttgggactcaaactgccagtgaaggatttggaactgggcactcagtgctagtccagtggtgtgggatggtcca

SEQ ID NO: 184506 - DNA, 7084 bp, Homo sapiens
  Payload ID: 16332
  Gene Symbol: SLC6A5
  Gene Name: solute carrier family 6 (neurotransmitter transporter), member 5
  Uniprot ID: Q9Y345
  ENST ID: ENST00000525748
  CDS Start-End: 274-2667
cacgccaaacacgcagccccctcccgctggagtgacaactggccagcatactctaggctgttgtccctttaaaacttgaatccaagggggtaatgatttatcaaacttgtattatcaagaaaatgtcaaaccaagggcaccttgctttgcactgacgcaaacccggcctttcccaaggagatatagaaagcgcctctcctgcctgagccaaacccagtcttgtcaatagcgggtttcaccctccaccagttcagtctgttgcctgtgtcagacatggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgctgcactgtaagatcccttttctgcgaggcccggagggggatgcgaacgtgagtgtgggcaagggcaccctggagcggaacaatacccctgttgtgggctgggtgaacatgagccagagcaccgtggtgctggccacggatggaatcacgtccgtgctcccgggcagcgtggccaccgttgccacccaggaggacgagcaaggggatgagaataaggcccgagggaactggtccagcaaactggacttcatcctgtccatggtggggtacgcagtggggctgggcaatgtctggaggtttccctacctggccttccagaacgggggaggtgctttcctcatcccttacctgatgatgctggctctggctggattacccatcttcttcttggaggtgtcgctgggccagtttgccagccagggaccagtgtctgtgtggaaggccatcccagctctacaaggctgtggcatcgcgatgctgatcatctctgtcctaatagccatatactacaatgtgattatttgctatacacttttctacctgtttgcctcctttgtgtctgtactaccctggggctcctgcaacaacccttggaatacgccagaatgcaaagataaaaccaaacttttattagattcctgtgttatcagtgaccatcccaaaatacagatcaagaactcgactttctgcatgaccgcttatcccaacgtgacaatggttaatttcaccagccaggccaataagacatttgtcagtggaagtgaagagtacttcaagtactttgtgctgaagatttctgcagggattgaatatcctggcgagatcaggtggccactagctctctgcctcttcctggcttgggtcattgtgtatgcatcattggctaaaggaatcaagacttcaggaaaagtggtgtacttcacggccacgttcccgtatgtcgtactcgtgatcctcctcatccgaggagtcaccctgcctggagctggagctgggatctggtacttcatcacacccaagtgggagaaactcacggatgccacggtgtggaaagatgctgccactcagattttcttctctttatctgctgcatggggaggcctgatcactctctcttcttacaacaaattccacaacaactgctacagggacactctaattgtcacctgcaccaacagtgccacaagcatctttgccggcttcgtcatcttctccgttatcggcttcatggccaatgaacgcaaagtcaacattgagaatgtggcagaccaagggccaggcattgcatttgtggtttacccggaagccttaaccaggctgcctctctctccgttctgggccatcatctttttcctgatgctcctcactcttggacttgacactatgtttgccaccatcgagaccatagtgacctccatctcagacgagtttcccaagtacctacgcacacacaagccagtgtttactctgggctgctgcatttgtttcttcatcatgggttttccaatgatcactcagggtggaatttacatgtttcagcttgtggacacctatgctgcctcctatgcccttgtcatcattgccatttttgagctcgtggggatctcttatgtgtatggcttgcaaagattctgtgaagatatagagatgatgattggattccagcctaacatcttctggaaagtctgctgggcatttgtaaccccaaccattttaacctttatcctttgcttcagcttttaccagtgggagcccatgacctatggctcttaccgctatcctaactggtccatggtgctcggatggctaatgctcgcctgttccgtcatctggatcccaattatgtttgtgataaaaatgcatctggcccctggaagatttattgagaggctgaagttggtgtgctcgccacagccggactggggcccattcttagctcaacaccgcggggagcgttacaagaacatgatcgaccccttgggaacctcttccttgggactcaaactgccagtgaaggatttggaactgggcactcagtgctagtccagtggtgtgggatggtccagacttgatcctgtttttcctctctgcctcctcctaatgttttccatagctctcctcccatttttcttcatctttcttcctacatcttggttcacatccacgcatgagagtgattatgtagaaaagtaggcatagtgtcgcatgctgcagtaaagagctacatagaccacctgaagcgctgtttgcctgtgcccatggtgactgtttctggtcaggttggtcccctgaccacacgttttaccctgcagaggaggatcagttaggtgagcactggtaggtatgcgtggttttgtcaatagagaggtatccactgtgtgatggcatggggggtgccagtaaggcatgtatagagtggccgaattacaagactttatttggacttgaacagaactgagcaatgtggtgatcttgttcagacacacaaagttcaagacaggtttttttttttttcagagagttagcagtggtcagaaaatgttttggatgtaagacaagaccattcaatttggacaccactgaggtggttaagtttatatttccagtcaccactggggatctgtttccttcgtttggatcagcaatctccagttaccactaactcagatgctacagtctacacattgtgactttgattgaactgtcagttttcttccctcaactgtctttttttgttttaaataaccacatttgtgagttcttttggtcatttcctccacctctgcccaagaagccatcatataagttgtgcctcattttgtacgttcatagtagagctccatgctcatttctacatgatatttagcaccatggttcaatgtcacgatcctgtgtttcttctctaaatgtctttctataagctgtagacaccttgtcttttgacctctgggaaaacaagacttaccctggttctgtctatatattatatatataggacacatgctcttaaaagacagataacttcttaatttttactctttttcattcacagtaaatgccaactgtggtcatagagaaatcaaagaaatggagagtttaatagaaagcaaccacaatattcactgcactggtagtacattttaggacatggtatttatagaactttctgataaatacagcttaggtaagtagcgagtgagccaattaagactatagcttttaagactacatttagccaattcaattttaagagttccctattcacagtactcattttaacggcactctaatgagagctgatcatatgtctgcagaaattggcaaagtgtaaactttattatcttcttgtatcctgaacatgcatatatgaaatttttaaaatgtgacatgtgttcatgtagtgtgtacttgtagtggtgttttctgtccttataaatatcttttgaattctgtagagatggtgagtttagtatagtgtagtctggggattttattttcccttacagtaataatatctaaacctaaaattgtttcctttaggggagatcatttcaatcattttcttcatttatcttcatagtacagggtctcaggcaaagtttttcagttcaaatcttgtatattgttgtgacattttcatcctgtttaacagcaatgaaacccaacaacaggctttaatgtacatttttttttaaaagatttcatttgttaaaaaaagtctcaactcattttactgagctctcccttttctagggcaagtatcatcgccatttgccaacatcaatatgaacttccagtttttaagagtagcttgtgaaaggttttagaaaaggaaacaaagatgggttttgaactttagattttcatgtcttttgtctgcagtgtatatttgttctcccctctccttctcctcctttccccccttgtctcccaaagctcaaacttgcttgagtctatcatagagactaaaccttgagcttcccctaaacttagctttaggaagctgagctgtggcctcacctgtctgccatgaacacagatttctctaagaaagccatattgatgagaagcccccaattactgcagcagacgtcgcacaatggtaccaaaaatgagcctctccagctgatacctggtagagtgagaggagccaggaggaataacttaggcctggaaattatctgcaggctttgcaatttgaaggttgagaaagagagcttaaatcaattagcattctctcatgggactggtatgtttgtgtcaggatgaatggtttttggctctcctgttgcctcttggctaaaactctgattgagccaatggttgcagtctgatgctggacgccaacccaatttctgctaattattgcttttgtgattaaaagaaggtgggggtggggggctcccacagatgctgccaggtttgttttgtacaaactgaaagttaacttaattgtgagaacggagacctcatcactagctgcatgttttggatttgggggcatttacatttgtgttaattatgatttgtccaggtaagatgcagtagctgctccctgagcagctgtttcccccccaccccacttcactataatttccaagatttatttccctttgtttaaagggacacgcttaggtgaaaggttccaaatttacctggaaatggttaccttgtaaatttagcttgtctaatggattgtttccatgatattaaaatgtacagtcaattggaagaaaaaaaatgaaaaaaataaaatgaataacattgttagaaactggcacctgaaaacttcccttcaaagtgggggaaaaaaccgagtagctgaggaaagactttcattggttcactgtgtagaatggtggagcattttccacttgtgagattatttcataacaccaacaaatgccagaaactcattcagaaaaaaagccatatgtgaaaaacagtaatcctgtcatatccttagaggagaaaaaatgtatatttcttaacaagtggtgttgtgacttcttatgcaaatgtcttgcatattagtaacttttattatctttaggactgtgcttatcaggtacaaatgtgtctagttctgttttattgtttctttttcctttatatttatgtattgcatgaggtctgtggtcaatgcaaaatcatgatgacctcaatgtctttgaaatttgcaatgtgtttttaatatgtaagaaatgtaatcaacttgtatttcagtaagcagcactttaaaaagagtttaacatgatgacctttaaatggataggacttgggttgtttttatggtaatgttgcattggagttgagttttcctttaattaagttcttgtttcctcatctatgtgtctctcagtgcttcctgtccacctttgctctcagcatggtttcccatgcctaaaagtaagattttcttttctctttgttcccttggctgtaggtcattgtcctcttcccagaggctagcacaataactgttgctcaatgtaagatgagatggcaagatcatactactgttgttgcacctggatttgagttgggacatgcttctttgaggcagatgattcaagagaggacgtgctgtgtggcaggtgttttgcaggaccaaaaggccaaggccaacagaggagcatttccttctctttcacactgggtatcaagcagaaaacttccaggctgggagcaaaggtgtgggtgattctgccttgatactcatttccccacaaagtggccctaggatttgtgaaagtgaagcttcctatctttcccagattttgctttaattgcccagaaaggccaagtagttttgaaatgtggtctttgctcaggtcacctctgagcagcctgcagccaaagagaaagtgttttcagattaggtattcatcacctctgaaaagcaagcagtggtttgacttgcctgccacggattaaatacatcttcaggtaaccatttgccttacaggtgtattttactgttaggatgattcttagtaattgactaaaaactgttttgtctctcatttgtttgtggtttttgcactttattatggacctgtaaaggaataggttaattcttacattgtgtacttggctaatgtcctaaatgcaggcatcttttgtgggtactgttgcccatgaataaacatatgttccctaatcaggtccttatatttttccattaactatacatgaagaaaatatattatgttacaaatgatgcatcatatatatatatatatatatatatatatcttatagattacatattatatactgcacattattcatttaagaagtcattcttgaggccctacctcaaattttctatttatgtataaaaatgcaatttattgtattatatatttgcctattatgtactgatataaattagaatttaccctaataatgtatgagttcacaaaaccctaaataaatgtcagtgtttaaaacatga

SEQ ID NO: 184507 - DNA, 284 bp, Homo sapiens
  Payload ID: 16333
  Gene Symbol: SLC6A6
  Gene Name: solute carrier family 6 (neurotransmitter transporter), member 6
  ENST ID: ENST00000452151
  CDS Start-End: 1-284
gacaatgatgccgctgcccacattttggtccattcttttttttattatgcttctcttgcttggactggatagccagggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaacc

SEQ ID NO: 184508 - DNA, 458 bp, Homo sapiens
  Payload ID: 16333
  Gene Symbol: SLC6A6
  Gene Name: solute carrier family 6 (neurotransmitter transporter), member 6
  ENST ID: ENST00000452775
  CDS Start-End: 130-458
aagtccaacagtgcgcgactccccaggtcaggagaagccccgatgtgtgcagaatctgcagatggggctgctctcggccctgcctctggctgtggaaacaggcctccaagtacccaagaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcat

SEQ ID NO: 184509 - DNA, 6528 bp, Homo sapiens
  Payload ID: 16333
  Gene Symbol: SLC6A6
  Gene Name: solute carrier family 6 (neurotransmitter transporter), member 6
  Uniprot ID: P31641
  ENST ID: ENST00000622186
  CDS Start-End: 326-2188
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatcc

SEQ ID NO: 184510 - DNA, 6526 bp, Homo sapiens
  Payload ID: 16333
  Gene Symbol: SLC6A6
  Gene Name: solute carrier family 6 (neurotransmitter transporter), member 6
  ENST ID: ENST00000613060
  CDS Start-End: 19-2184
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaaccaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaa

SEQ ID NO: 184511 - DNA, 6401 bp, Homo sapiens
  Payload ID: 16333
  Gene Symbol: SLC6A6
  Gene Name: solute carrier family 6 (neurotransmitter transporter), member 6
  ENST ID: ENST00000618278
  CDS Start-End: 19-1401
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaaccaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaa

SEQ ID NO: 184512 - DNA, 1116 bp, Homo sapiens
  Payload ID: 16333
  Gene Symbol: SLC6A6
  Gene Name: solute carrier family 6 (neurotransmitter transporter), member 6
  ENST ID: ENST00000622176
  CDS Start-End: 1-368
aacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtctcaggcccctttgggactgtgatgagtgtcctagacgctccccagaacaaagcacatacactagacccaagttgcccacagtttcaaagggtttatggacccgctgaagccattagtggacaccaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaag

SEQ ID NO: 184513 - DNA, 1983 bp, Homo sapiens
  Payload ID: 16333
  Gene Symbol: SLC6A6
  Gene Name: solute carrier family 6 (neurotransmitter transporter), member 6
  ENST ID: ENST00000610642
  CDS Start-End: 19-417
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggtgagtacagattttttcatgtcctttctcaaggctctcctttgggcttctctacttagaagcttcagaagcagagaatactaacagaaattcaatttgagttgaacagtaggccctccctacctagactacacaaataatctcactgtagccacactgaagatcctcctggtgctaaaggtgtgaggtgtgactggatgttttcacagtttcagaacttggttgtgcaggacctggaatactccttttttatctccttgaggccttgggtttgagtttgggctgtgcctaagattgcacacctagggtttggagtgtgcctcagattgccag

SEQ ID NO: 184514 - DNA, 1252 bp, Homo sapiens
  Payload ID: 16333
  Gene Symbol: SLC6A6
  Gene Name: solute carrier family 6 (neurotransmitter transporter), member 6
  Uniprot ID: P31641
  ENST ID: ENST00000621751
  CDS Start-End: 282-884
cagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgcacagagaaaaa

SEQ ID NO: 184515 - DNA, 3739 bp, Homo sapiens
  Payload ID: 16334
  Gene Symbol: SLC6A7
  Gene Name: solute carrier family 6 (neurotransmitter transporter), member 7
  Uniprot ID: Q99884
  ENST ID: ENST00000230671
  CDS Start-End: 372-2282
agaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcatggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtgaggcaggaggcaggcgggcagaaggccctgcccgggacctcacagtcccttcttagaagcctgcaaaggtcagctgtgccctctgggattctgagaggctatgggggggcctgccatagggatgccagtcccccagtgggggtcccttctgcagcctctgcctctcctgaaacctctgacaaccccctacacacacacacaggcatactcagacccactcaaagctgagaatgatccaactcagccctactttgcggatggacatattaaggccaggaggggagggacttgccccaggtcgcatggcagaggggacttgaacccacgcctcctgaccagccagctccctttcccatggggcagccggcaccaccttctcatctctattcagggcctacacccctccctttttggggggagcctgtccccacacaccttagcacaaccagaatcttgagttgggcagggaaggtcagggctacagaggctcttgaggctccgaggccctggggatcaaaggtcaatgagttaggtggggagaaagatccctgggggctcctgtatgcaggactcctgaaggaggtgggagctgagggccctggaggatggggaaggtttgcagagagaggaagaagagggcagggtggggaggagctctgggccagaggatgctgagctgcctgggcagagaccaagagggttggagacactagttttaccaggttacaggagggttcaagacagaaggaaaactaacagagggggagccagggatgatggggtgggcaggggatttgcatgatgaggagtatcattccagatctgtgcagagcggatcggacgggacagggtggagcggggaggcctgtgcaaagtgggaaagagctgccggtggcctgagccagggtgctggggctgcgggtggggaaaggaggccccagcacttcagacaaagaccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgcgtccccccaaccccttgtgttctattggttcattgttaataaatatcaaatgaggtcacgctcctta

SEQ ID NO: 184516 - DNA, 2431 bp, Homo sapiens
  Payload ID: 16334
  Gene Symbol: SLC6A7
  Gene Name: solute carrier family 6 (neurotransmitter transporter), member 7
  ENST ID: ENST00000524041
  CDS Start-End: 244-2244
atgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcatggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagggcacatctgctaggggtcttctctatgcaagaatgacagtatctgccacgtacatccggagcacggacaagatgctgtcctgccttcaaggagcacacagttctgcagaaacttgcttaggtgacttcaaaccagagatctgtggtgaggaagtgacggtggtggggtgatgacatgggagaattccagcaaaatccacctgggagaaccagcagctccactccacggacagagtggatctctgcggcacagcaacgcagcgaccccagcctggtccctcagctgtaagacacacacggggtgcttctcagggcatggtgtttcctgcttgggcaacccacccaccctgccgcttta

SEQ ID NO: 184517 - DNA, 3763 bp, Homo sapiens
  Payload ID: 16335
  Gene Symbol: SLC6A8
  Gene Name: solute carrier family 6 (neurotransmitter transporter), member 8
  Uniprot ID: P48029
  ENST ID: ENST00000253122
  CDS Start-End: 477-2384
gcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcagg

SEQ ID NO: 184518 - DNA, 266 bp, Homo sapiens
  Payload ID: 16335
  Gene Symbol: SLC6A8
  Gene Name: solute carrier family 6 (neurotransmitter transporter), member 8
  ENST ID: ENST00000457723
  CDS Start-End: 1-266
ggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccaggtgtggagggcttcatcaccggcctcct

SEQ ID NO: 184519 - DNA, 468 bp, Homo sapiens
  Payload ID: 16335
  Gene Symbol: SLC6A8
  Gene Name: solute carrier family 6 (neurotransmitter transporter), member 8
  ENST ID: ENST00000413787
  CDS Start-End: 1-468
ctgctacattcccctacgtggtcctggtcgtgctgctggtgcgtggagtgctgctgcctggcgccctggatggcatcatttactatctcaagcctgactggtcaaagctggggtcccctcagccctgggcagctacaaccgcttcaacaacaactgctacaatgggaccagcttctttgctggcttcgtggtcttctccatcctgggcttcatggctgcagagcagggcgtgcacatctccaaggtggcagagtcagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtac

SEQ ID NO: 184520 - DNA, 1892 bp, Homo sapiens
  Payload ID: 16335
  Gene Symbol: SLC6A8
  Gene Name: solute carrier family 6 (neurotransmitter transporter), member 8
  Uniprot ID: P48029
  ENST ID: ENST00000430077
  CDS Start-End: 217-1779
gtgtgtcctgtgactacaaaacagcactggggttgctggaagccgaagtgacccggtgatgggtgggaaacagaggtccagagcaaaggcctttgcccaaggtcaggagaaggatgctgggacctggagtcaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctg

SEQ ID NO: 184521 - DNA, 523 bp, Homo sapiens
  Payload ID: 16335
  Gene Symbol: SLC6A8
  Gene Name: solute carrier family 6 (neurotransmitter transporter), member 8
  ENST ID: ENST00000442457
  CDS Start-End: 1-523
ggatagatgcggggacccagattttcttttcttacgccattggcctgggggccctcacagccctgggcagctacaaccgcttcaacaacaactgctacaatgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttggga

SEQ ID NO: 184522 - DNA, 334 bp, Homo sapiens
  Payload ID: 16335
  Gene Symbol: SLC6A8
  Gene Name: solute carrier family 6 (neurotransmitter transporter), member 8
  ENST ID: ENST00000429147
  CDS Start-End: 1-334
cttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagcccta

SEQ ID NO: 184523 - DNA, 2168 bp, Homo sapiens
  Payload ID: 16336
  Gene Symbol: SLC6A9
  Gene Name: solute carrier family 6 (neurotransmitter transporter, glycine), member 9
  Uniprot ID: P48067
  ENST ID: ENST00000357730
  CDS Start-End: 193-2151
cccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgtgaatgagcggcggagacacgcgggctgcgatcgctcgccccaggatggccgcggctcatggacctgtggccccctcttccccagaacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccagggga

SEQ ID NO: 184524 - DNA, 2330 bp, Homo sapiens
  Payload ID: 16336
  Gene Symbol: SLC6A9
  Gene Name: solute carrier family 6 (neurotransmitter transporter, glycine), member 9
  Uniprot ID: P48067
  ENST ID: ENST00000360584
  CDS Start-End: 193-2313
cccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgtgaatgagcggcggagacacgcgggctgcgatcgctcgccccaggatggccgcggctcatggacctgtggccccctcttccccagaacaggtgacgcttctccctgttcagagatccttcttcctgccacccttttctggagccactccctctacttccctagcagagtctgtcctcaaagtctggcatggggcctacaactctggtctccttccccaactcatggcccagcactccctagccatggcccagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccagggga

SEQ ID NO: 184525 - DNA, 1926 bp, Homo sapiens
  Payload ID: 16336
  Gene Symbol: SLC6A9
  Gene Name: solute carrier family 6 (neurotransmitter transporter, glycine), member 9
  ENST ID: ENST00000372306
  CDS Start-End: 141-1880
acctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctgaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacggtgagcactcgagcctccggcctcccgcgacccggcccttggcccgcccactctgtcctgcgggtctgctgaccccccatctctccagggcaccggaactacttccaggacatccagatgatgctgggattcccaccacccctcttctttcagatctgctggcgcttcgtctctcccgccatcatcttcctccaggctcaggtccaccgccgcctcccccagaatcctcttcacttcgcgtcgctcccggagcggaacgtgctcctccaccagctcccacagcgagggggagtgccggagcatgacccaccgacgccgccgtccccggctcggacctacgggccgcaggtc

SEQ ID NO: 184526 - DNA, 2162 bp, Homo sapiens
  Payload ID: 16336
  Gene Symbol: SLC6A9
  Gene Name: solute carrier family 6 (neurotransmitter transporter, glycine), member 9
  ENST ID: ENST00000372307
  CDS Start-End: 329-2053
ttttccagggtccagggcaagtgcccgcatgggctgggagccggtgtgtcctcatccctggacgccggggacgggtggagatgtcagcggatggcagcgagggtgaggagactcgaaagctacacttctcccctgtaggacatcctgacttgaccttcaaaagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttcctccaggctcaggtccaccgccgcctcccccagaatcctcttcacttcgcgtcgctcccggagcggaacgtgctcctccaccagctcccacagcgagggggagtgccggagcatgacccaccgacgccgccgtccccggctcggacctacgggccgcaggtcagagtgcgggaggtaccgcgggcccgccggcaacgctcaccaaaccccgcccctctatgggccccgccctctcccaagccccacccgtgctctgccgctggtcccctcggctgggattgcccgttccggaactgccagtccttggcgctctcttctgcccggcttttggccgactcggatgccgggggcccagaaaccaggcagtgggaaccagggccctagccccacctcttccgcgtggccatcacccgggaaaccacgccgcgactctagggccccgccccctcccgtgtttggtccggcgggcggcgcgtgccggctgggagttcag

SEQ ID NO: 184527 - DNA, 3130 bp, Homo sapiens
  Payload ID: 16336
  Gene Symbol: SLC6A9
  Gene Name: solute carrier family 6 (neurotransmitter transporter, glycine), member 9
  Uniprot ID: P48067
  ENST ID: ENST00000372310
  CDS Start-End: 167-2068
gatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctgaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccaggggagtggccccacccccaccccgtgctcccaccgcagagactggtgaggcagaggccaggtgtctctgcctgccccctgccacgccctggccaggacggctgctgtcaccttggtcaccactgctagtgcagtcattcatgctcatgtccccagtgtttacatgtcctttggatgccaagatagcagctggggggaggggtgggagtggagggttgctgggaggtccaaagcactttggaggggtctcgggccaggtccccagcagcctggatggctttacgtggcctccgatacccttataccctgccctgagctgaggttctgggtgggcctccagccccatgactagtgctcctgccctcagagccgaccccagcctctgccaggcacatttggctattcctccctaggggcaggatgaagggctgggggactgcccagtgttacttgtcaggctgtgctgcccagccctgtttatctgtgtaattatttttgtaaacattgtattctctgtggtcgccacctcctcgcccccagcctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccagcaccctggggaaggggaccctgcacgacacccccttgccctccctccatgaggctaaaggcccagtcttcccaaatgtgctgccctcgttcatgtgccaaatggccccagcccacatgcccctcccctctctggagtgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttctattcctgtctctga

SEQ ID NO: 184528 - DNA, 591 bp, Homo sapiens
  Payload ID: 16336
  Gene Symbol: SLC6A9
  Gene Name: solute carrier family 6 (neurotransmitter transporter, glycine), member 9
  ENST ID: ENST00000466926
  CDS Start-End: 243-591
acaacaggctgtggaagagctgcgagcggcgcggcggggcgggcgaactcggcgcggcacagagcctcgggaggctgatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctggtgacgcttctccctgttcagagatccttcttcctgccacccttttctggagccactccctctacttccctagcagagtctgtcctcaaagtctggcatggggcctacaactctggtctccttccccaactcatggcccagcactccctagccatggcccagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggag

SEQ ID NO: 184529 - DNA, 1881 bp, Homo sapiens
  Payload ID: 16336
  Gene Symbol: SLC6A9
  Gene Name: solute carrier family 6 (neurotransmitter transporter, glycine), member 9
  ENST ID: ENST00000475075
  CDS Start-End: 211-1779
gatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccaggggagtggccccacccccaccccgtgctcccaccgcagagactggtgaggcagaggccaggtgtctctgcctgccccctgccacgccct

SEQ ID NO: 184530 - DNA, 524 bp, Homo sapiens
  Payload ID: 16336
  Gene Symbol: SLC6A9
  Gene Name: solute carrier family 6 (neurotransmitter transporter, glycine), member 9
  ENST ID: ENST00000528803
  CDS Start-End: 122-524
aacaaaccccacacaccccactccagctccggagcacccgtgctgggctgcatggggactggccggaggggcagggccaggggagcgggtaggcagagcttcgggaggagatgaggtgtgaatgagcggcggagacacgcgggctgcgatcgctcgccccaggatggccgcggctcatggacctgtggccccctcttccccagaacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgt

SEQ ID NO: 184531 - DNA, 4879 bp, Homo sapiens
  Payload ID: 16337
  Gene Symbol: SLC6A15
  Gene Name: solute carrier family 6 (neutral amino acid transporter), member 15
  Uniprot ID: Q9H2J7
  ENST ID: ENST00000266682
  CDS Start-End: 543-2735
gtaacacgggcgggccgagcacgtgggcgcctccgtcacaccctcacacatacacacacgcgcgcgcgcacacacacatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttgctgattcaatattgtctgcaaagtataaaagactatgatttttaaataaaactgttgtatatatgaaattggatagagcagaggaacctcactgagtgtcctctagttaaaaatctttcatttatcctaccaccagatcagttacatttttaaaacaatgatggatatagcagcaaaataagtgaggtaatacacatgccatatcaattgatttatttcagccagtattctcgctctgctatagatagatgttaataaatggtatcacagcatttaaagtattaaatccactggtgcataaatttttagtcttttaaaatatattcatgaatattgtgtttgtatccctttaaaatgtttaatattttataaataggcagtatatgcacattatacaaaactaaaaaattatgacaattcagtgtgaagtaagttctcatccaacatttctcctggccatccattctccatctttaaaggcaatcaccattgccagtttcttctgtatccttctggaaatacaatatattacataaatgacagcattctatattctctcttctatatcttacctatttctgtgaataatttattttggacagcattttatgtatgaatattcacaaatgtgcttccttatttcagaggctgaactaataaaaattttgtttatttttgtgttgaggcaatatttttatatggtaccctaatctttaatacttaacctgccagactttaaccgtaacacaataatgtattgccaaatagcaccattcttcttctctcactctcttgccatgggggctcttaaaaaaaaaagtatacatctaaggtgtacaacatgctgttttgatgtatataaatatagtgaaagcaaataaagtatatatctaaggtgtacaa

SEQ ID NO: 184532 - DNA, 3108 bp, Homo sapiens
  Payload ID: 16337
  Gene Symbol: SLC6A15
  Gene Name: solute carrier family 6 (neutral amino acid transporter), member 15
  ENST ID: ENST00000309283
  CDS Start-End: 12-962
agcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttgctgattcaatattgtctgcaaagtataaaagactatgatttttaaataaaactgttgtatatatgaaattggatagagcagaggaacctcactgagtgtcctctagttaaaaatctttcatttatcctaccaccagatcagttacatttttaaaacaatgatggatatagcagcaaaataagtgaggtaatacacatgccatatcaattgatttatttcagccagtattctcgctctgctatagatagatgttaataaatggtatcacagcatttaaagtattaaatccactggtgcataaatttttagtcttttaaaatatattcatgaatattgtgtttgtatccctttaaaatgtttaatattttataaataggcagtatatgcacattatacaaaactaaaaaattatgacaattcagtgtgaagtaagttctcatccaacatttctcctggccatccattctccatctttaaaggcaatcaccattgccagtttcttctgtatccttctggaaatacaatatattacataaatgacagcattctatattctctcttctatatcttacctatttctgtgaataatttattttggacagcattttatgtatgaatattcacaaatgtgcttccttatttcagaggctgaactaataaaaattttgtttatttttg

SEQ ID NO: 184533 - DNA, 4229 bp, Homo sapiens
  Payload ID: 16337
  Gene Symbol: SLC6A15
  Gene Name: solute carrier family 6 (neutral amino acid transporter), member 15
  Uniprot ID: Q9H2J7
  ENST ID: ENST00000450363
  CDS Start-End: 460-1329
atgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaagttagtatgttagagcccttcctcattctgctaatcaccatttctggattcatccctctctcaaattctgttacagatttctgtgggcaaatcacacataacacttcattctaggtagttaaatattagtgaaaagtgacacttcaaaagtgtgcttacatttttaaaaagacaaataaaaacagtgttttatagtgaaatctaaggttaattataatctttccttatttcaacaagatctttaaaatttttgtgaatacttaaaagtcctttctttttgccctttattcaattagtcctaatgtttcagttctctaattaccaattagttaaattatggaaattggggaaagtggtaaaatgagtaattcattcattttgtttgtttgatatcatttgtttctctctgctgtaggtgttctaaggaatagctgcataagacattttgaaataatgtaatgtgaagtgtttcttaaagctctgaacatcattaagtagttaataataattccaacaaggaattcagagtaatgtaaaagactaaatatcattccttctaaggcaaattgaaaattagaatggttgtggtttaaaaagacattaagtgaattctaggtagcttgtttgttattatttttaaaggacgctctaggaaagtaattgctattcactattttgctttcgtattactttttttttttttttttcattatcacagccattgttctaaagctctccacatctcttggctggatcatagcaagaatttactgttggctcttctctctgccgtttaactgtccagctgtgctattttccttttcaaagtataactgatttcaggctaacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttactttatatttaattaaaaattttagtgactttttaacttgtaaattgtagctgattttacatttatcttcctgaaggaaactctgtatcattttgtcttttgaatttgtgaatatacttgttaacacatctaaatatctttaagtctttggcaatgttattgtattatatgactaaataacttcgaattgttcaattgtgtatgtcttccactatgtcagagccacattcccgtcacattataaatgaaggagtggattcttaaataagacctaaccatatttatatgattcctaacataatatcatttggtagaaagaaaaccaactgtggtcatccagagaagctcaaaaactcttgtactcaggttctcttactaccacgttttgtttctgtttcttcttagtctgtgtcttagcatcacttaaagaactattcatccttttcttatcacagaatcttggggttgttcttctcatgtcatgtagtgtaaatttatatagaaaatgtaatacaatttatttagtacatacatttattattttaatgagaatgcctcaggaaaagactagtatttgggcaatatttgaagaaagaatttaacaggcactgatggggagaaagctagctgtaggtaatgtgagcaaagatgtggaagccaaaattgtcacaattcctcaatctgaaacaatgagttaaatataataacaatgactttatgaggaattaaaggttaagctttgtgtttacctactaaacagaaaatgcctccaaataaacagtgtcacaagtacagaagagagaaatattgtttaaggctagcacatggaaaaacaacttagaggatttagcagctaaaagaagaatgagtcagctggtgatgtgcttggtcaaaacacacagtcatacatgcatatacatataccccaaaatgctaagtggaaactgcatgaattaaaagaggggtatgatagggacattgtcctttgggctaggtaggcacatatcagttggaccacatctgcaatactggattttactgaaatcttgtattttcctttttattatgagaaatttcagctcagtgatcaaagtcttcaaatagttaaaccaaaagaagaatagggctgctttgtgtggccatagagagcaaaactatgatcaaatagtgggtattatggaggaggttgtgatggtggtaagccttcaaagaaagaaaggcctttcaagaatcaaacttgataataatgaaatcagttgcctcaatggtagagagctcagcatcactggaggtggtcacacagaggtagcatgtgccctagttacagaatctattaaggggatgactgtctcaaatatgtaggacagaaatgagaagccccaagcttgcttttaactctaaggtagtattttctactctgactactttcctgttgttactactactatgctaaatactatgcatacattatcttgtttattctttctatcagctagataatttgcatattttatccccattttactgcaaagttgacaagctcagggaaaataaatagttggccagaattaagcaaccaatacatgatagacagggctaaaactgggctacagaattttcaaaaagaatgatacattctgaaggtatgtttataataaacatttttcatatgtaaaacaa

SEQ ID NO: 184534 - DNA, 563 bp, Homo sapiens
  Payload ID: 16337
  Gene Symbol: SLC6A15
  Gene Name: solute carrier family 6 (neutral amino acid transporter), member 15
  ENST ID: ENST00000549540
  CDS Start-End: 276-563
attcgcttccgttcgctttagcaaaggcagaaggcgactaccgaggacagagtgttttcacgtgaccacagttcccctttgcttgaggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggc

SEQ ID NO: 184535 - DNA, 582 bp, Homo sapiens
  Payload ID: 16337
  Gene Symbol: SLC6A15
  Gene Name: solute carrier family 6 (neutral amino acid transporter), member 15
  ENST ID: ENST00000551612
  CDS Start-End: 368-582
atgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacgatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttct

SEQ ID NO: 184536 - DNA, 2221 bp, Homo sapiens
  Payload ID: 16337
  Gene Symbol: SLC6A15
  Gene Name: solute carrier family 6 (neutral amino acid transporter), member 15
  Uniprot ID: Q9H2J7
  ENST ID: ENST00000552192
  CDS Start-End: 312-2183
acatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttt

SEQ ID NO: 184537 - DNA, 546 bp, Homo sapiens
  Payload ID: 16337
  Gene Symbol: SLC6A15
  Gene Name: solute carrier family 6 (neutral amino acid transporter), member 15
  ENST ID: ENST00000551010
  CDS Start-End: 488-546
gtttaggggacggttcagccattttcaaaaggaggctaagctttgtgttcagaggtgtatattttaggaattctccacgtggcttaattacgagcatgccttgattgttagcagagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgt

SEQ ID NO: 184538 - DNA, 6427 bp, Homo sapiens
  Payload ID: 16338
  Gene Symbol: SLC6A17
  Gene Name: solute carrier family 6 (neutral amino acid transporter), member 17
  Uniprot ID: Q9H1V8
  ENST ID: ENST00000331565
  CDS Start-End: 486-2669
agggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtccctgaatgagaaggagctgacagcagctgaattccatcttctctgtgtgctggggagcagggctacacggcccaggtggcatcaatgccgaagaacagcaaagtgacccagcgtgagcacagcagtgagcatgtcactgagtccgtggccgacctgctggccctcgaggagcctgtggactataagcagagtgtactgaatgtggctggtgaggcaggcggcaagcagaaggcggtggaggaggagctggatgcagaggaccggccggcctggaacagtaagctgcagtacatcctggcccagattggcttctctgtgggcctcggcaacatctggaggttcccctacctgtgccagaaaaatggaggaggtgcttacctggtgccctacctggtgctgctgatcatcatcgggatccccctcttcttcctggagctggctgtgggtcagaggatccgccgcggcagcatcggtgtgtggcactatatatgtccccgcctggggggcatcggcttctccagctgcatagtctgtctctttgtggggctgtattataatgtgatcatcgggtggagcatcttctatttcttcaagtccttccagtacccgctgccctggagtgaatgtcctgtcgtcaggaatgggagcgtggcagtggtggaggcagagtgtgaaaagagctcagccactacctacttctggtaccgagaggccttggacatctctgactccatctcggagagtgggggcctcaactggaagatgaccctgtgcctcctcgtggcctggagcatcgtggggatggctgtcgttaagggcatccagtcctcggggaaggtgatgtatttcagctccctcttcccctacgtggtgctggcctgcttcctggtccgggggctgttgctgcgaggggcagttgatggcatcctacacatgttcactcccaagctggacaagatgctggacccccaggtgtggcgggaggcagctacccaggtcttctttgccttgggcctgggctttggtggtgtcattgccttctccagctacaataagcaggacaacaactgccacttcgatgccgccctggtgtccttcatcaacttcttcacgtcagtgttggccaccctcgtggtgtttgctgtgctgggcttcaaggccaacatcatgaatgagaagtgtgtggtcgagaatgctgagaaaatcctagggtaccttaacaccaacgtcctgagccgggacctcatcccaccccacgtcaacttctcccacctgaccacaaaggactacatggagatgtacaatgtcatcatgaccgtgaaggaggaccagttctcagccctgggccttgacccctgccttctggaggacgagctggacaagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacagtgggctgctgtgtctttgcattcctcgtggggctgttgttcgtccagcgctccggaaactactttgtcaccatgttcgatgactactcggccaccctgccactcactctcatcgtcatccttgagaacatcgctgtggcctggatttatggaaccaagaagttcatgcaggagctgacggagatgctgggcttccgcccctaccgcttctatttctacatgtggaagttcgtgtctccactatgcatggctgtgctcaccacagccagcatcatccagctgggggtcacgcccccgggctacagcgcctggatcaaggaggaggctgccgagcgctacctgtatttccccaactgggccatggcactcctgatcaccctcatcgtcgtggcgacgctgcccatccctgtggtgttcgtcctgcggcacttccacctgctctctgatggctccaacaccctctccgtgtcctacaagaagggccgcatgatgaaggacatctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtgaccactgcccaagccctgcccgcctctccccccacgctcaacctgcccacttgtccaggcctggcctctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccactcatctagccctccaagagcctccgccaaattgtagccatgtaattggaacaacccataaggcctgcttcccagtccatgggagattccaagtggccactgcaggagtcactcacctccctctctccctgtaacttgccacctgcagttcttagggctgtggggtcagatggtggtggtgagaggccttggggctggggaaggagagtggactttggctcactctgccatgagaacaggacaccatcctgcccagcccagacggggttgctcctggtccaagaggctacctgctccaaggcggagggtgggagcaggtgtgccagggctcagggctcagacttgggagggcctaggcagaagccccaagttctgttttctgaggtatgtgctgcccttggcttcagcatgagccttggtagcagaaggtgaggaacctcctctgccctggtccctgggtggaatcttcccatgtccttggccctgcctggggtgtgtggtgtgtgctcctgcatcttgtctgggagtgcagtgaccgggaccagaaccttccccacctcaattagggcttagccatctccctgtccccagcacccctccccagcccacagtggtggcctctgcctctttcctggagagagaaggacagtgcacggagaggtttccagagcacaaattgttggttcctagcacaaattagatggtttggagcacaatggtgaagcacactcccctccctcctcacctggggtccaatgttctgtctagtggcagcttttcccctggaacaggggtccctggagttcacaggcttatccccaggaagcctcactcctggggaaagacagataatttcactgcccctttgagccaccactcactctccttattacacaagcacagccgcccagtgtgcacatcatgtgcagacaccttggaaacctttcccaagccttcctggcccacagtggccagtgccataggcagtgctgtggacagtagaggctgccaaaggcaagggctggtcttcaggatggaggccagcctgtgcagaaggctgcagctgacaacagcgaccccacctgccattaccttcagggcctcctctggaagagaacccattctcagagtgcagccagggaggaacctgacccaagagtaaatgtctgcagagagatggatggatggatggatagatggatggatgggttggggagtgggggtggatggatggatagatggatggatggatggatggatgggttggggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaacccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccagccccagaatcctggaggagcaggaggtagcaggagaggaccaggtccccaagtcccttcacagggtccccacccccactggctttggtgctgtccacacagtgcccaccagaaggcagagggaactccagggcagggatgtgcctgaaagagtcaacagtcccctgatcccctacctctgcctgccctccagccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttaccaaa

SEQ ID NO: 184539 - DNA, 2121 bp, Homo sapiens
  Payload ID: 16339
  Gene Symbol: SLC6A18
  Gene Name: solute carrier family 6 (neutral amino acid transporter), member 18
  Uniprot ID: Q96N87
  ENST ID: ENST00000324642
  CDS Start-End: 124-2010
aatacaactgcagtggggctgcttgtggtttccaaacgtcggcagaggctggagacggctctctagtgctgggtgtggagtgaggcaccacccttgccctgaagcctggggcactcagtcaccatggctcatgccccagaaccggacccggccgcctgcgacctcggggatgagaggcccaagtgggacaacaaggcccagtacctcctgagctgcactgggtttgccgtgggactggggaacatttggcggttcccatacctgtgccagacctatggaggaggggccttcctcatcccctacgtcatcgcgctggtcttcgaggggatccccattttccacgtcgagctcgccatcggccagcggctgcggaagggcagcgtcggcgtgtggacggccatctccccgtacctcagtggagtagggctgggctgtgtcacgctgtccttcctgatcagcctgtactacaacaccatcgtggcgtgggtgctgtggtacctcctcaactccttccagcacccgctgccctggagctcctgcccaccggacctcaacagaacagggtttgtggaggagtgccagggcagcagcgccgtgagctacttctggtaccggcagacactgaacatcacagccgacatcaatgacagtggctccatccagtggtggctgctcatctgcttggcagcctcctgggcagtcgtgtacatgtgtgtcatcaggggcattgagactacagggaaggtgatttacttcacagctttgttcccttacctggtcctgaccatctttctcatcagagggctgaccctgccaggggcaacaaaaggactcatctacttgttcactcccaacatgcacattctccagaacccccgggtgtggctggacgcagccacccagatattcttctctctgtccctggccttcggaggacacatcgcttttgcaagttacaactcgcccaggaatgactgccagaaggatgcggtggtcatcgccctggtcaacaggatgacctccctgtacgcgtccatcgctgtcttctctgtcctggggttcaaagcaactaatgactacgagcactgcctggacagaaacatcctcagcctcatcaacgactttgacttcccagagcagagcatctccagggacgactacccagccgtcctcatgcacctgaacgccacctggcccaagagggtggcccagctccccctgaaggcctgcctcctggaagactttctggataagagtgcctcgggcccgggcctggccttcgtcgtcttcacggagaccgacctccacatgccgggggctcctgtgtgggccatgctcttcttcgggatgctgttcaccttggggctatcgaccatgttcgggaccgtggaggcggtcatcacacccctgctggacgtgggggtcctgcctagatgggtccccaaggaggccctgactgggctggtctgcctggtctgcttcctctccgccacctgcttcacgctgcagtctgggaactactggctggagattttcgacaattttgccgcttccccgaacctgctcatgttggcctttctcgaggttgtgggtgtcgtttatgtttatggaatgaaacggttctgcgatgacattgcgtggatgaccgggaggcggcccagcccctactggcggctgacctggagggtggtcagtcccctgctgctgaccatctttgtggcttacatcatcctcctgttctggaagccactgagatacaaggcctggaaccccaaatacgagctgttcccctcgcgtcaggagaagctctacccgggctgggcgcgcgccgcctgtgtgctgctgtccttgctgcccgtgctgtgggtcccggtggccgcgcttgctcagctgctcacccggcggaggcggacgtggagggacagggacgcgcgcccagacacggacatgcgcccggacacggacacgcgcccagacacggacatgcgcccggacacggacatgcgctgaagccggccggagcggggcctgcatgggcgggtctgtgggggggcttggcctgatggtgggcggggccccgcccacagggccgaccccaatacaccagcgactcaaccttga

SEQ ID NO: 184540 - DNA, 5174 bp, Homo sapiens
  Payload ID: 16340
  Gene Symbol: SLC6A19
  Gene Name: solute carrier family 6 (neutral amino acid transporter), member 19
  Uniprot ID: Q695T7
  ENST ID: ENST00000304460
  CDS Start-End: 57-1961
actcgccctccagcttctgccctgcctgctgtgtgcggagccgtccagcgaccaccatggtgaggctcgtgctgcccaaccccggcctagacgcccggatcccgtccctggctgagctggagaccatcgagcaggaggaggccagctcccggccgaagtgggacaacaaggcgcagtacatgctcacctgcctgggcttctgcgtgggcctcggcaacgtgtggcgcttcccctacctgtgtcagagccacggaggaggagccttcatgatcccgttcctcatcctgctggtcctggagggcatccccctgctgtacctggagttcgccatcgggcagcggctgcggcggggcagcctgggtgtgtggagctccatccacccggccctgaagggcctaggcctggcctccatgctcacgtccttcatggtgggactgtattacaacaccatcatctcctggatcatgtggtacttattcaactccttccaggagcctctgccctggagcgactgcccgctcaacgagaaccagacagggtatgtggacgagtgcgccaggagctcccctgtggactacttctggtaccgagagacgctcaacatctccacgtccatcagcgactcgggctccatccagtggtggatgctgctgtgcctggcctgcgcatggagcgtcctgtacatgtgcaccatccgcggcatcgagaccaccgggaaggccgtgtacatcacctccacgctgccctatgtcgtcctgaccatcttcctcatccgaggcctgacgctgaagggcgccaccaatggcatcgtcttcctcttcacgcccaacgtcacggagctggcccagccggacacctggctggacgcgggcgcacaggtcttcttctccttctccctggccttcgggggcctcatctccttctccagctacaactctgtgcacaacaactgcgagaaggactcggtgattgtgtccatcatcaacggcttcacatcggtgtatgtggccatcgtggtctactccgtcattgggttccgcgccacacagcgctacgacgactgcttcagcacgaacatcctgaccctcatcaacgggttcgacctgcctgaaggcaacgtgacccaggagaactttgtggacatgcagcagcggtgcaacgcctccgaccccgcggcctacgcgcagctggtgttccagacctgcgacatcaacgccttcctctcagaggccgtggagggcacaggcctggccttcatcgtcttcaccgaggccatcaccaagatgccgttgtccccactgtggtctgtgctcttcttcattatgctcttctgcctggggctgtcatctatgtttgggaacatggagggcgtcgttgtgcccctgcaggacctcagagtcatccccccgaagtggcccaaggaggtgctcacaggcctcatctgcctggggacattcctcattggcttcatcttcacgctgaactccggccagtactggctctccctgctggacagctatgccggctccattcccctgctcatcatcgccttctgcgagatgttctctgtggtctacgtgtacggtgtggacaggttcaataaggacatcgagttcatgatcggccacaagcccaacatcttctggcaagtcacgtggcgcgtggtcagccccctgctcatgctgatcatcttcctcttcttcttcgtggtagaggtcagtcaggagctgacctacagcatctgggaccctggctacgaggaatttcccaaatcccagaagatctcctacccgaactgggtgtatgtggtggtggtgattgtggctggagtgccctccctcaccatccctggctatgccatctacaagctcatcaggaaccactgccagaagccaggggaccatcaggggctggtgagcacactgtccacagcctccatgaacggggacctgaagtactgagaaggcccatcccacggcgtgccatacactggtgtcagggaaggaggaaccagcaagacctgtggggtgggggccgggctgcacctgcatgtgtgtaagcgtgagtgtatgctcgtgtgtgagtgtgtgtattgtacacgcatgtgccatgtgtgcagatatgtatcgtgtgtgcatgtacatgcatgggcactgtgtgagtgtgcacgtgtatgcacacatatacatgtgtgtgggtgtgtgtattgtatgtgcatgtgccatgtgtgcagatgtgtcatgttgtgtgtgtgcatgtacatgtatggacattgtgtgagtgtgcaagtgtgcatgcatatacatgtgtgcgatatttgctgcccgtgtgtgtgcatgtatatatagacatacatgcctatgttgtgtgtggtgtgcatatgtgtgaacacacacgtgtatacatgcatgcacatgtgctcgtacaatgggtgtccacatgcacgtgtatatgtatatctgtgagtgtatatacatgcatgcaattgtgtgtatgtgtgttctgtgtgtgcgtttgcaagtatatatgcacatgtgtatatgtacatgtatgcctgtgtgacgtgtgtatatgtgagcatgtgtacgtgtgtgtatacgtgtgttgtgtatatgtgtgtgtctgtacctgtttgtgtatatgtgtgtgatgtgtgctcgtgtgtgtgcatattcaggcaggtgtgcatttgtgcatgccagtgtgtatgtatgtgcgcatatggacacgcatggacacgcatatggacacatatggacacacatatggacacgtgtggatatgtgtgcgtacacgtcgctgggacacatgcctgccactcggggcccagctgccctctgtgtttgtccttgccacagtcacggggtgcatgtgcagaggggagcagaccactggggacgtgctgtgccctgcacgtgcccgggggaagcggaagctgcagctggggtgggggcagcacctctatgcttcatctctgtgggtggcaggagacaaaagcacagggtactatcttggctcctgggagcgactcttgctacccacccccacccatccccttccccttggtgttgacctttgacctgggggttcccagagccctgtagccctcgacccggagcagcctctcggaagccggagtgggcagttgctggcgattctgagaaaacttggccgcatccaccggggccctgcctccagtcggccgctgccgagtctctgcgttctggccgcttcccggcttaatgaatgccagccatttaatcattgctcctgccaccacaaatagatgagcagttaaataaaactcaacttggcataattcaaggcaaataccactctgtgcattttcttaagaggacatgagctgtgtgaatttttagccagcctttggaaaagatgggttacagggtaactcaaccctggctgccatccttgggcactgtgtgtgtccagggcaccttggaggaccgtgcagcccccagaagcttccagctcccgcaccactcagtgaagcccagcctggcgcctgccctgcccccgtcacgggatgggcccccattggggttcaacattccatcgcagccaaaggcagtcggcacttgggacatctgcttccacggacaggtcacctccgctttgcacggaagaatctggatgcttacattaaactggtgttctgagagttcctacggacaggtcacctccgctttgcatggaagaatctggatgcttacattaaactggtgttctgagagttcctacggacaggtcacctctgctttccatagaagaatctggacgcttacattaaactgatgttctgagaattcctacaggcaggactgaaagcctggtgtgtgccagtatgatgttccacccacagaaacctggtcacaatcgtcccttccagcaccccatccagcagtgactgcacacactgagtcccctaccagcccctttcaccctgctgactgtcactgggccctgggatgcgcaagactccacagcagcagaggtggggggacatatcacagcctctgcccccggctgtgatgccaccgaggggctcgcctgctgatggcttcaacagggtctcacctcatcttttcctgctctttggccctggatcgagaaaatttccatcagtgccccattaatatgctgccctgtggcatctgcccaggaggccctgccaggcgtgcacaggtgtgcattggtgtaccctggcatgcacaggtgtgcactgatgtgccctggcatccattggtgtaccctggtgtgcctgccataggaccctgggcgggagctcccatctcatctacatctcctgattcatgcgttgtttcataggtttcaatgtctctgtaaatgtggtagaaatgcaggctttatgggcataaagtgtacatttctaaataaatcccttctattgagtatgctcaccctagaagttactgttgtccagacgtagagggatgagtgagccagtgacctcagacgggatggtggggacggcaggtccagctcctgcctcctcctggggggtctggctttgggggcttgctccgaagaggccatggcccaggcctgtggcctcacaatggggaccaaccagctcttctcatcttcttccctcacacttcctctcactcaaataagaaccttccaaaaatgtgtccacctgggcccctgccctgggactcatggatttggagttgtggccacacggttgaggggtgcagtgtccagtggaatggggcaattgcgggcctgggggcccttggcctgtccgtggcgggagcatctgcaaggaggagccccagagtccagggagcactgtggggagctccttagagctgaactcacccggcgtcaactcatcaaccctccacccatggacaggggtgcccccagcacaggagaggactcagccctctgcccccacgcacggtgggtgcctgtcaccctgtcctgcccagcggcccgagggcagcagtgggtgtgagggcagcccccggcctcccaagagcagctgagaggatccctgcgggaatccgggcttcgggtgcatgcgatctgatctgagttgtttctgacagtgacagagtgacaatctataagtatctcaagatcaaatggttaaataaaacataagaaatttaaaacgattaaaa

SEQ ID NO: 184541 - DNA, 3337 bp, Homo sapiens
  Payload ID: 16340
  Gene Symbol: SLC6A19
  Gene Name: solute carrier family 6 (neutral amino acid transporter), member 19
  ENST ID: ENST00000515652
  CDS Start-End: 57-1121
actcgccctccagcttctgccctgcctgctgtgtgcggagccgtccagcgaccaccatggtgaggctcgtgctgcccaaccccggcctagacgcccggatcccgtccctggctgagctggagaccatcgagcaggaggaggccagctcccggccgaagtgggacaacaaggcgcagtacatgctcacctgcctgggcttctgcgtgggcctcggcaacgtgtggcgcttcccctacctgtgtcagagccacggaggaggagccttcatgatcccgttcctcatcctgctggtcctggagggcatccccctgctgtacctggagttcgccatcgggcagcggctgcggcggggcagcctgggtgtgtggagctccatccacccggccctgaagggcctaggagcctctgccctggagcgactgcccgctcaacgagaaccagacagggtatgtggacgagtgcgccaggagctcccctgtggactacttctggtaccgagagacgctcaacatctccacgtccatcagcgactcgggctccatccagtggtggatgctgctgtgcctggcctgcgcatggagcgtcctgtacatgtgcaccatccgcggcatcgagaccaccgggaaggccgtgtacatcacctccacgctgccctatgtcgtcctgaccatcttcctcatccgaggcctgacgctgaagggcgccaccaatggcatcgtcttcctcttcacgcccaacgtcacggagctggcccagccggacacctggctggacgcgggcgcacaggtcttcttctccttctccctggccttcgggggcctcatctccttctccagctacaactctgtgcacaacaactgcgagaaggactcggtgattgtgtccatcatcaacggcttcacatcggtgtatgtggccatcgtggtctactccgtcattgggttccgcgccacacagcgctacgacgactgcttcagcacgtgagtggctgtcccaccatcctggtgccttgggctgcgcctccaggaagcctcccagcctccctggccccaggtggccgtcagcctcaatctgacccgcaggaacatcctgaccctcatcaacgggttcgacctgcctgaaggcaacgtgacccaggagaactttgtggacatgcagcagcggtgcaacgcctccgaccccgcggcctacgcgcagctggtgttccagacctgcgacatcaacgccttcctctcagaggccgtggagggcacaggcctggccttcatcgtcttcaccgaggccatcaccaagatgccgttgtccccactgtggtctgtgctcttcttcattatgctcttctgcctggggctgtcatctatgtttgggaacatggagggcgtcgttgtgcccctgcaggacctcagagtcatccccccgaagtggcccaaggaggtgctcacaggcctcatctgcctggggacattcctcattggcttcatcttcacgctgaactccggccagtactggctctccctgctggacagctatgccggctccattcccctgctcatcatcgccttctgcgagatgttctctgtggtctacgtgtacggtgtggacaggttcaataaggacatcgagttcatgatcggccacaagcccaacatcttctggcaagtcacgtggcgcgtggtcagccccctgctcatgctgatcatcttcctcttcttcttcgtggtagaggtcagtcaggagctgacctacagcatctgggaccctggctacgaggaatttcccaaatcccagaagatctcctacccgaactgggtgtatgtggtggtggtgattgtggctggagtgccctccctcaccatccctggctatgccatctacaagctcatcaggaaccactgccagaagccaggggaccatcaggggctggtgagcacactgtccacagcctccatgaacggggacctgaagtactgagaaggcccatcccacggcgtgccatacactggtgtcagggaaggaggaaccagcaagacctgtggggtgggggccgggctgcacctgcatgtgtgtaagcgtgagtgtatgctcgtgtgtgagtgtgtgtattgtacacgcatgtgccatgtgtgcagatatgtatcgtgtgtgcatgtacatgcatgggcactgtgtgagtgtgcacgtgtatgcacacatatacatgtgtgtgggtgtgtgtattgtatgtgcatgtgccatgtgtgcagatgtgtcatgttgtgtgtgtgcatgtacatgtatggacattgtgtgagtgtgcaagtgtgcatgcatatacatgtgtgcgatatttgctgcccgtgtgtgtgcatgtatatatagacatacatgcctatgttgtgtgtggtgtgcatatgtgtgaacacacacgtgtatacatgcatgcacatgtgctcgtacaatgggtgtccacatgcacgtgtatatgtatatctgtgagtgtatatacatgcatgcaattgtgtgtatgtgtgttctgtgtgtgcgtttgcaagtatatatgcacatgtgtatatgtacatgtatgcctgtgtgacgtgtgtatatgtgagcatgtgtacgtgtgtgtatacgtgtgttgtgtatatgtgtgtgtctgtacctgtttgtgtatatgtgtgtgatgtgtgctcgtgtgtgtgcatattcaggcaggtgtgcatttgtgcatgccagtgtgtatgtatgtgcgcatatggacacgcatggacacgcatatggacacatatggacacacatatggacacgtgtggatatgtgtgcgtacacgtcgctgggacacatgcctgccactcggggcccagctgccctctgtgtttgtccttgccacagtcacggggtgcatgtgcagaggggagcagaccactggggacgtgctgtgccctgcacgtgcccgggggaagcggaagctgcagctggggtgggggcagcacctctatgcttcatctctgtgggtggcaggagacaaaagcacagggtactatcttggctcctgggagcgactcttgctacccacccccacccatccccttccccttggtgttgacctttgacctgggggttcccagagccctgtagccctcgacccggagcagcctctcggaagccggagtgggcagttgctggcgattctgagaaaacttggccgcatccaccggggccctgcctccagtcggccgctgccgagtctctgcgttctggccgcttcccggcttaatgaatgccagccatttaatcattgctcctgccaccacaaatagatgagcagttaaataaaactcaacttggcataattcaaggc

SEQ ID NO: 184542 - DNA, 5247 bp, Homo sapiens
  Payload ID: 16341
  Gene Symbol: SLC6A20
  Gene Name: solute carrier family 6 (proline IMINO transporter), member 20
  Uniprot ID: Q9NP91
  ENST ID: ENST00000353278
  CDS Start-End: 52-1719
actgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtatctac

SEQ ID NO: 184543 - DNA, 5423 bp, Homo sapiens
  Payload ID: 16341
  Gene Symbol: SLC6A20
  Gene Name: solute carrier family 6 (proline IMINO transporter), member 20
  Uniprot ID: Q9NP91
  ENST ID: ENST00000358525
  CDS Start-End: 117-1895
gaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtatctac

SEQ ID NO: 184544 - DNA, 910 bp, Homo sapiens
  Payload ID: 16341
  Gene Symbol: SLC6A20
  Gene Name: solute carrier family 6 (proline IMINO transporter), member 20
  ENST ID: ENST00000413781
  CDS Start-End: 117-910
gaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaa

SEQ ID NO: 184545 - DNA, 2662 bp, Homo sapiens
  Payload ID: 16341
  Gene Symbol: SLC6A20
  Gene Name: solute carrier family 6 (proline IMINO transporter), member 20
  ENST ID: ENST00000456124
  CDS Start-End: 65-1708
accgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatct

SEQ ID NO: 184546 - DNA, 2938 bp, Homo sapiens
  Payload ID: 16342
  Gene Symbol: SLC6A16
  Gene Name: solute carrier family 6, member 16
  Uniprot ID: Q9GZN6
  ENST ID: ENST00000335875
  CDS Start-End: 243-2453
gcagagaatcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcacctcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactgggaa

SEQ ID NO: 184547 - DNA, 2983 bp, Homo sapiens
  Payload ID: 16342
  Gene Symbol: SLC6A16
  Gene Name: solute carrier family 6, member 16
  Uniprot ID: Q9GZN6
  ENST ID: ENST00000454748
  CDS Start-End: 203-2182
aggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcaccgtgagcctcccccaggacccagaacccctttgggagtaggggccagacctttcaattcactctgggtgaaagaacccagtcatctcattctcttactgcccgaagactcatgggttttctgctttggttccccacccatccttcccctccacaactcttccttttctcttggggattttgatattctgaacccttttcccatctctccacagtcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaa

SEQ ID NO: 184548 - DNA, 794 bp, Homo sapiens
  Payload ID: 16342
  Gene Symbol: SLC6A16
  Gene Name: solute carrier family 6, member 16
  ENST ID: ENST00000598828
  CDS Start-End: 305-794
ggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtc

SEQ ID NO: 184549 - DNA, 453 bp, Homo sapiens
  Payload ID: 16342
  Gene Symbol: SLC6A16
  Gene Name: solute carrier family 6, member 16
  ENST ID: ENST00000594180
  CDS Start-End: 1-102
ttgttggttttcacatctttcaacttctgtgtcctgggcttctgggcgacagtcatcacacatcgctgctgtgagagcagagacagggtttcaccgtgttagccaggacggtctcgatcttctgacctcgtgatccgcccgcctcggcctcccaaagtgctgggattacagacgtgagccaccacgccaggcctaatctgtgcttttaaaatgctgtataatgtttcagtatatgaatataccacagtttttaaaaatccattcaactattgataacatttggagtctttccagttttatgctattaaaacaatgttgctgcaaacattcttatgcatgttcctgatgtactacatatgtgcacatttttctgggatatgagttagattgttggggcatagttgtctattcttgggtaacaaatcactctggaagtaaatggattaaaacaac

SEQ ID NO: 184550 - DNA, 410 bp, Homo sapiens
  Payload ID: 16342
  Gene Symbol: SLC6A16
  Gene Name: solute carrier family 6, member 16
  ENST ID: ENST00000594917
  CDS Start-End: 1-410
tgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaagcagagacagggtttcaccgtgttagccaggacggtctcgatcttctga

SEQ ID NO: 184551 - DNA, 642 bp, Homo sapiens
  Payload ID: 16342
  Gene Symbol: SLC6A16
  Gene Name: solute carrier family 6, member 16
  ENST ID: ENST00000597969
  CDS Start-End: 1-442
gtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagcagagacagggtttcaccgtgttagccaggacggtctcgatcttctgacctcgtgatccgcccgcctcggcctcccaaagtgctgggattacagacgtgagccaccacgccaggcctaatctgtgcttttaaaatgctgtataatgtttcagtatatgaatataccacagtttttaaaaatccattcaactattgataacatttggagtctttccagttttatgctattaaaacaatgttgctgcaaa

SEQ ID NO: 184552 - DNA, 1761 bp, Homo sapiens
  Payload ID: 16343
  Gene Symbol: SLC7A9
  Gene Name: solute carrier family 7 (amino acid transporter light chain, bo,+ system), member 9
  Uniprot ID: P82251
  ENST ID: ENST00000023064
  CDS Start-End: 193-1656
ccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgttt

SEQ ID NO: 184553 - DNA, 1752 bp, Homo sapiens
  Payload ID: 16343
  Gene Symbol: SLC7A9
  Gene Name: solute carrier family 7 (amino acid transporter light chain, bo,+ system), member 9
  Uniprot ID: P82251
  ENST ID: ENST00000590341
  CDS Start-End: 178-1641
ggcacgggcggtcagctgggccgcagctcctccggctctgcagggtcacggaggaaggtaagtaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgtttaaaata

SEQ ID NO: 184554 - DNA, 1030 bp, Homo sapiens
  Payload ID: 16343
  Gene Symbol: SLC7A9
  Gene Name: solute carrier family 7 (amino acid transporter light chain, bo,+ system), member 9
  ENST ID: ENST00000592232
  CDS Start-End: 6-125
gaaacatgggggatactggcctgagaaagcggagagaggatgagaagtcgatccagagccaagagcctaagaccaccagtctccaaaaggaggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatctgaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctga

SEQ ID NO: 184555 - DNA, 1998 bp, Homo sapiens
  Payload ID: 16343
  Gene Symbol: SLC7A9
  Gene Name: solute carrier family 7 (amino acid transporter light chain, bo,+ system), member 9
  ENST ID: ENST00000590465
  CDS Start-End: 163-282
ggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggaggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatctgaatcaactcaattacatcacagaagaacttagaaacccttacaggtaacagctgaatcagtgcagaggacagtagccgggcagcctgatttctcttctcctggtgaaggctggagctatttccctgggtattccatgatgcccttcccgacagtgaattatttctttttttttttttttgagacagagtcttgctctgttgcctaggctggagtgcagtggtgcaatctcagctcactcatttttgtatttttttagtagagatgagattttgccatgttggccaggctggtcttgaactcccaacctcaagagattcgcccatctcggcctcccaaagtgctgggattacaggtgtgagccactgcacccggccagcgaatggtttcttatgagctcactatgcacgcttagagtttggtttggtttgggacagagcagtggctcctaagggagggaagagcttggtcttcctttatctctggcttattttgctttataaacagttccatgtgaactgctctggagtctgagagaggcagcattctcatttgaaaatgtcttatgttcctgctgggcctctgctacctgcgaatcttctccctgggagggcctcagggagggcgtccatcttccgcgggaggctgtggtctgaacgtgggtctccgtgtcattgcccctcccagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgttt

SEQ ID NO: 184556 - DNA, 1568 bp, Homo sapiens
  Payload ID: 16343
  Gene Symbol: SLC7A9
  Gene Name: solute carrier family 7 (amino acid transporter light chain, bo,+ system), member 9
  Uniprot ID: P82251
  ENST ID: ENST00000587772
  CDS Start-End: 105-1568
atttctagggttggaccgtgcaggcacgggcggtcagctgggccgcagctcctccggctctgcagggtcacggaggaagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaa

SEQ ID NO: 184557 - DNA, 4537 bp, Homo sapiens
  Payload ID: 16344
  Gene Symbol: SLC7A5
  Gene Name: solute carrier family 7 (amino acid transporter light chain, L system), member 5
  Uniprot ID: Q01650
  ENST ID: ENST00000261622
  CDS Start-End: 67-1590
gcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 184558 - DNA, 3983 bp, Homo sapiens
  Payload ID: 16344
  Gene Symbol: SLC7A5
  Gene Name: solute carrier family 7 (amino acid transporter light chain, L system), member 5
  ENST ID: ENST00000565644
  CDS Start-End: 311-1036
gtcctttcacgcgtgtcttcgtgttggtgcgcttttcactggtcataaagtgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 184559 - DNA, 4216 bp, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENST ID: ENST00000316902
  CDS Start-End: 727-2334
tcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaa

SEQ ID NO: 184560 - DNA, 3066 bp, Homo sapiens
  Payload ID: 16345
  Gene Symbol: SLC7A8
  Gene Name: solute carrier family 7 (amino acid transporter light chain, L system), member 8
  ENST ID: ENST00000339733
  CDS Start-End: 1-692
tgtgcctccaggagcactcacagccctcacagcttctctgcaccctcctcctctgctggtgtgtccttggaagagagaggcccttccggaaggctcagagcacctcctctcctttggagggggttccgagatttctaaaacgtttgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagcccctgccctaccaggggtgagtgtgggaccacagagccgagggaagcccagcctttgcccttgaggatgtgtctctgtgggtgaagaagagagagaatgccccagtccctagtcctgggggccacgtggcctacacagttcatacgcctcatgcctctgctccacagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaa

SEQ ID NO: 184561 - DNA, 1752 bp, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENST ID: ENST00000453702
  CDS Start-End: 245-1243
caacctccagcctgggcacccagacccagagggctgctgggagggacatgcctcaccccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttc

SEQ ID NO: 184562 - DNA, 3018 bp, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENST ID: ENST00000422941
  CDS Start-End: 203-1138
gtagccacacccacgcccccacaggcccggcttccctgcccagcggctccaacctccagcctgggcacccagacccagagggctgctgggagggacatgcctcaccccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatg

SEQ ID NO: 184563 - DNA, 1819 bp, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENST ID: ENST00000529705
  CDS Start-End: 101-1393
gtggtgattcagcagaaaccccagctccagcagctggcgcaggagctaacaggataagaaggaaggggaagagagagccaggaagggaggaggggaggggatggggcagtatgggcaggagcttagctggaagtgtttggtaaaagctgtgtgcctccaggagcactcacagccctcacagcttctctgcaccctcctcctctgctggtgtgtccttggaagagagaggcccttccggaaggctcagagcacctcctctcctttggagggggttccgagatttctaaaacgtttgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatca

SEQ ID NO: 184564 - DNA, 536 bp, Homo sapiens
  Payload ID: 16345
  Gene Symbol: SLC7A8
  Gene Name: solute carrier family 7 (amino acid transporter light chain, L system), member 8
  ENST ID: ENST00000524758
  CDS Start-End: 254-536
aagagaagcacgttagtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctg

SEQ ID NO: 184565 - DNA, 3557 bp, Homo sapiens
  Payload ID: 16345
  Gene Symbol: SLC7A8
  Gene Name: solute carrier family 7 (amino acid transporter light chain, L system), member 8
  ENST ID: ENST00000469263
  CDS Start-End: 728-1597
ctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaaagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatgg

SEQ ID NO: 184566 - DNA, 1499 bp, Homo sapiens
  Payload ID: 16345
  Gene Symbol: SLC7A8
  Gene Name: solute carrier family 7 (amino acid transporter light chain, L system), member 8
  ENST ID: ENST00000528860
  CDS Start-End: 237-386
agcctgggcacccagacccagagggctgctgggagggacatgcctcaccccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgt

SEQ ID NO: 184567 - DNA, 658 bp, Homo sapiens
  Payload ID: 16345
  Gene Symbol: SLC7A8
  Gene Name: solute carrier family 7 (amino acid transporter light chain, L system), member 8
  ENST ID: ENST00000525062
  CDS Start-End: 425-658
gaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtc

SEQ ID NO: 184568 - DNA, 2267 bp, Homo sapiens
  Payload ID: 16345
  Gene Symbol: SLC7A8
  Gene Name: solute carrier family 7 (amino acid transporter light chain, L system), member 8
  ENST ID: ENST00000618208
  CDS Start-End: 1356-2267
agtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggaggggctcagggacagaggaggctaa

SEQ ID NO: 184569 - DNA, 4227 bp, Homo sapiens
  Payload ID: 16345
  Gene Symbol: SLC7A8
  Gene Name: solute carrier family 7 (amino acid transporter light chain, L system), member 8
  ENST ID: ENST00000617478
  CDS Start-End: 1356-1988
agtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctccacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatgg

SEQ ID NO: 184570 - DNA, 1371 bp, Homo sapiens
  Payload ID: 16345
  Gene Symbol: SLC7A8
  Gene Name: solute carrier family 7 (amino acid transporter light chain, L system), member 8
  ENST ID: ENST00000621729
  CDS Start-End: 384-1016
tcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggacacacccctctctctgcttttgtcaggcagtggtaggactttggtgtgggtggtgagaaattgt

SEQ ID NO: 184571 - DNA, 6251 bp, Homo sapiens
  Payload ID: 16346
  Gene Symbol: SLC7A6
  Gene Name: solute carrier family 7 (amino acid transporter light chain, y+L system), member 6
  Uniprot ID: Q92536
  ENST ID: ENST00000219343
  CDS Start-End: 213-1760
cggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 184572 - DNA, 5074 bp, Homo sapiens
  Payload ID: 16346
  Gene Symbol: SLC7A6
  Gene Name: solute carrier family 7 (amino acid transporter light chain, y+L system), member 6
  ENST ID: ENST00000379152
  CDS Start-End: 195-884
gcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccaggaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 184573 - DNA, 1030 bp, Homo sapiens
  Payload ID: 16346
  Gene Symbol: SLC7A6
  Gene Name: solute carrier family 7 (amino acid transporter light chain, y+L system), member 6
  ENST ID: ENST00000563080
  CDS Start-End: 168-812
agagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtaacctgccatctgcattcaaatttacctcacttactgatgagtttcttttggccatgaagaggtcttgtgtctcctgtggtttggaaccttgggagtctgggtgggaaagagtctgctgacatttgtgaactgtgcctatgtcaagtggggcacacgtgtgcaggacacgttcacttacgccaaggtcgtagcgctcattgccatcattgtcatgggccttgttaaactgtgccaggacatttgctgaccagacgtttggcatgttcagctggaccatccccattgctgttgccctgtcctgctttgggggcctcaatgcatccatctttgcttcatc

SEQ ID NO: 184574 - DNA, 6308 bp, Homo sapiens
  Payload ID: 16346
  Gene Symbol: SLC7A6
  Gene Name: solute carrier family 7 (amino acid transporter light chain, y+L system), member 6
  Uniprot ID: Q92536
  ENST ID: ENST00000566454
  CDS Start-End: 270-1817
cgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 184575 - DNA, 510 bp, Homo sapiens
  Payload ID: 16346
  Gene Symbol: SLC7A6
  Gene Name: solute carrier family 7 (amino acid transporter light chain, y+L system), member 6
  ENST ID: ENST00000568088
  CDS Start-End: 426-510
actgggaggtaacgggctgggccatgggcgggcgcgccgggagcggggccggggctgggccgcgttctgtgggagccgaaccctgtgggtcttcgctgccgccgtcgggagcgggatgcggcccagaaacagcgcggggctggccgatcggggccgcgcgagaggcgctgcggagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtca

SEQ ID NO: 184576 - DNA, 514 bp, Homo sapiens
  Payload ID: 16346
  Gene Symbol: SLC7A6
  Gene Name: solute carrier family 7 (amino acid transporter light chain, y+L system), member 6
  ENST ID: ENST00000563146
  CDS Start-End: 240-514
ggccgaggcagacaagtggaattaggccttgctgcaggggacttcatttccttctcagtactggacccatttatgaggaggtggcttatgaaagtgtgatgttcgcgtatttcttgacagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgt

SEQ ID NO: 184577 - DNA, 526 bp, Homo sapiens
  Payload ID: 16346
  Gene Symbol: SLC7A6
  Gene Name: solute carrier family 7 (amino acid transporter light chain, y+L system), member 6
  ENST ID: ENST00000566579
  CDS Start-End: 1-383
tgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatataaatttgcccttggccattgggatttctatgccaattgtgacgctcatctacatcctgaccaatgtggcctattacacagtgctgaacatttcagatgtccttagcagtgatgctgtggctgtgacatttgctgaccagacgttt

SEQ ID NO: 184578 - DNA, 547 bp, Homo sapiens
  Payload ID: 16346
  Gene Symbol: SLC7A6
  Gene Name: solute carrier family 7 (amino acid transporter light chain, y+L system), member 6
  ENST ID: ENST00000564708
  CDS Start-End: 326-547
gggctgggccatgggcgggcgcgccgggagcggggccggggctgggccgcgttctgtgggagccgaaccctgtgggtcttcgctgccgccgtcgggagcgggatgcggcccagaaacagcgcggggctggccgatcggggccgcgcgagaggcgctgcggagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacact

SEQ ID NO: 184579 - DNA, 493 bp, Homo sapiens
  Payload ID: 16346
  Gene Symbol: SLC7A6
  Gene Name: solute carrier family 7 (amino acid transporter light chain, y+L system), member 6
  ENST ID: ENST00000562727
  CDS Start-End: 422-493
tcagtgcccagccatccggggcttgtctctcagaactgctcccagatttcagatctgggaggagcagacttgaaaggctgtgagtacttccttatatcagttccacctctttttggtggcggtgaggccttttggggacctgcccaggctgcctgcattactcaggtcccatgtgtgctgcgcagacggcttttgcttcccaactttgatctcagatcgttattcaagtcgttacactggagtttattttcctggcaatttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtg

SEQ ID NO: 184580 - DNA, 581 bp, Homo sapiens
  Payload ID: 16346
  Gene Symbol: SLC7A6
  Gene Name: solute carrier family 7 (amino acid transporter light chain, y+L system), member 6
  ENST ID: ENST00000568024
  CDS Start-End: 213-581
atggcttggtgccagagtgagagcaaaagtggtgctgccttaaagctcagcctcactgaagcagagaccaagtcttgctctgttgccaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcatt

SEQ ID NO: 184581 - DNA, 573 bp, Homo sapiens
  Payload ID: 16346
  Gene Symbol: SLC7A6
  Gene Name: solute carrier family 7 (amino acid transporter light chain, y+L system), member 6
  ENST ID: ENST00000566834
  CDS Start-End: 280-573
atcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatgggttgttgagcccaccggtcaggccatcatcgccatcacctttgccaactacatcatccagccgtccttccccagctgtgatcccccatacctggcctgccgtctcctggctgctgcttgcatatgtaacctgccatctgcattca

SEQ ID NO: 184582 - DNA, 543 bp, Homo sapiens
  Payload ID: 16346
  Gene Symbol: SLC7A6
  Gene Name: solute carrier family 7 (amino acid transporter light chain, y+L system), member 6
  ENST ID: ENST00000567346
  CDS Start-End: 1-153
gtgaactgtgcctatgtcaagtggggcacacgtgtgcaggacacgttcacttacgccaaggtcgtagcgctcattgccatcattgtcatgggccttgttaaactgtgccaggaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaatgtaagctttgctgggaccacggggctcaggtggatctgtgcattgctccttctgatttgtgctaagttgttaaataagagggaccctgagaaaggccttactctaa

SEQ ID NO: 184583 - DNA, 6124 bp, Homo sapiens
  Payload ID: 16346
  Gene Symbol: SLC7A6
  Gene Name: solute carrier family 7 (amino acid transporter light chain, y+L system), member 6
  ENST ID: ENST00000618043
  CDS Start-End: 227-916
ctgagctgccgcggcggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccaggaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggccttc

SEQ ID NO: 184584 - DNA, 2263 bp, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENST ID: ENST00000285850
  CDS Start-End: 340-1875
atttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaa

SEQ ID NO: 184585 - DNA, 2098 bp, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENST ID: ENST00000397528
  CDS Start-End: 243-1778
aatctcagcatgggaacaagcctttgtgtcacactgtgcaaccttcctccctttcttaaatgcttggggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttc

SEQ ID NO: 184586 - DNA, 2094 bp, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENST ID: ENST00000397529
  CDS Start-End: 202-1737
atttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtg

SEQ ID NO: 184587 - DNA, 2447 bp, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENST ID: ENST00000397532
  CDS Start-End: 527-2062
gcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 184588 - DNA, 847 bp, Homo sapiens
  Payload ID: 16347
  Gene Symbol: SLC7A7
  Gene Name: solute carrier family 7 (amino acid transporter light chain, y+L system), member 7
  ENST ID: ENST00000488800
  CDS Start-End: 424-847
atctgggttttcaatcacggctccgccatcttgggtcatcgtacggaaggagagacaaaactgcagtacaggtttttgagagctgtcaaatctctgctatatcagtactggctaaattaggtgttaaatgattgagcttcaagatgggcaaatcatgacttcggactacattcctccttgcctggcggctgggaaattccgtccgcgctgctgctaagacttcagatgaaagacgctccggggactccggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaact

SEQ ID NO: 184589 - DNA, 569 bp, Homo sapiens
  Payload ID: 16347
  Gene Symbol: SLC7A7
  Gene Name: solute carrier family 7 (amino acid transporter light chain, y+L system), member 7
  ENST ID: ENST00000557629
  CDS Start-End: 220-569
ttgctgcccgacgccttcccagcttagtggagcccactttctttggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgcttt

SEQ ID NO: 184590 - DNA, 720 bp, Homo sapiens
  Payload ID: 16347
  Gene Symbol: SLC7A7
  Gene Name: solute carrier family 7 (amino acid transporter light chain, y+L system), member 7
  ENST ID: ENST00000554758
  CDS Start-End: 227-720
tttgtgtcacactgtgcaaccttcctccctttcttaaatgcttggggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctg

SEQ ID NO: 184591 - DNA, 3017 bp, Homo sapiens
  Payload ID: 16347
  Gene Symbol: SLC7A7
  Gene Name: solute carrier family 7 (amino acid transporter light chain, y+L system), member 7
  ENST ID: ENST00000556287
  CDS Start-End: 1201-2133
tggagtgcagtggcctaatgtgggttcactgcaagctccgcctcccgggttcatgccattctcctcattctcctgcctcagcctcccgaatagctgggactacaggtgcccgccaccacgcccggctaatttttatttttttgtgtttttagtagagacggggtttcaccgtgttagccaggatggtcttgatctcctgaccttgtgatccgcctgcctcagcctcccaaagtgctgggattacaggcgtgagccaccgcgtctggcctgatttcctcatattttttaggaaagtggagtcaacttatatttgaggaaggcgtttataggaatttatgcttatcccagagatcttggtatgttttgtcaagaatgaaaaggcacgtgggtctggtggggatgcagtcagatatttgatctcttgactgtgtttcttttgaagtagtctgaggctcagactttggggcagtggcccaggcttggaggcaaccccccagtctctctttgcatggggaagtgtgcagagttctcttagaacacccagtcacatggtgtagagactgctcttacacttcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 184592 - DNA, 572 bp, Homo sapiens
  Payload ID: 16347
  Gene Symbol: SLC7A7
  Gene Name: solute carrier family 7 (amino acid transporter light chain, y+L system), member 7
  ENST ID: ENST00000557129
  CDS Start-End: 253-572
atattttttaggaaagtggagtcaacttatatttgaggaaggcgtttataggaatttatgcttatcccagagatcttggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatat

SEQ ID NO: 184593 - DNA, 505 bp, Homo sapiens
  Payload ID: 16347
  Gene Symbol: SLC7A7
  Gene Name: solute carrier family 7 (amino acid transporter light chain, y+L system), member 7
  ENST ID: ENST00000556350
  CDS Start-End: 1-505
acatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaa

SEQ ID NO: 184594 - DNA, 741 bp, Homo sapiens
  Payload ID: 16347
  Gene Symbol: SLC7A7
  Gene Name: solute carrier family 7 (amino acid transporter light chain, y+L system), member 7
  ENST ID: ENST00000554741
  CDS Start-End: 610-741
gtcaaatctctgctatatcagtactggctaaattaggtgttaaatgattgagcttcaagatgggcaaatcatgacttcggactacattcctccttgcctggcggctgggaaattcctgggagtgctgacagcaaacaaatgacaccgggaatggacaatatcactgggaagcatgttccaggcagggagaacaggagttgcaaaagctgtgaggcgggagcatgcttgctgtgcggccaccgcagggaagccagtgaagctggagtggagtggggaagacagcagggaggcccatgcagacaaggacagcttctctctttctaggacctcccttacgacttggacccgactccagagtgcaattaaggggccggcaagttgggtagcaggctgagagtgtctaaaggacactaaaatatctttggaataattcaggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgc

SEQ ID NO: 184595 - DNA, 2272 bp, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENST ID: ENST00000555702
  CDS Start-End: 349-1884
gttttcctgttttccatttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaa

SEQ ID NO: 184596 - DNA, 519 bp, Homo sapiens
  Payload ID: 16347
  Gene Symbol: SLC7A7
  Gene Name: solute carrier family 7 (amino acid transporter light chain, y+L system), member 7
  ENST ID: ENST00000555251
  CDS Start-End: 153-519
cattttcctctcagctgtctcctgttcggtgttttccagcatgtgctgcctggctgcagctgtctccctgccttggctcggggtgatatctctccagcagcaactctgggggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacct

SEQ ID NO: 184597 - DNA, 1158 bp, Homo sapiens
  Payload ID: 16347
  Gene Symbol: SLC7A7
  Gene Name: solute carrier family 7 (amino acid transporter light chain, y+L system), member 7
  ENST ID: ENST00000554517
  CDS Start-End: 384-1121
gttctcctaactagcaccttcccctctcccctgactcagctggtagcccctcctccccgcacctgcccaaaggtcactggacaggtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggttt

SEQ ID NO: 184598 - DNA, 476 bp, Homo sapiens
  Payload ID: 16347
  Gene Symbol: SLC7A7
  Gene Name: solute carrier family 7 (amino acid transporter light chain, y+L system), member 7
  ENST ID: ENST00000555959
  CDS Start-End: 386-476
ttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtggtgaagtgggtctacttgggctttgccagggctgaagactccagctaagggttaagggatgctctttgggcaggaggatggttgtgggtttccagcaggtttctgaagcctttagttttggcagacgtagagtccttggggaaaagagcagtgtcatgagacgctcccacagattagctgctggtaggggcaatgccaggaagctggtgaagggtttcctctcctccaccatggttgacagcactgagtatgaagtggcctcccagcctgaggtggaaacctcccctttgggtgatggggccagcccagggccggagcagg

SEQ ID NO: 184599 - DNA, 596 bp, Homo sapiens
  Payload ID: 16347
  Gene Symbol: SLC7A7
  Gene Name: solute carrier family 7 (amino acid transporter light chain, y+L system), member 7
  ENST ID: ENST00000555911
  CDS Start-End: 253-596
cctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattcct

SEQ ID NO: 184600 - DNA, 9645 bp, Homo sapiens
  Payload ID: 16348
  Gene Symbol: SLC7A11
  Gene Name: solute carrier family 7 (anionic amino acid transporter light chain, xc- system), member 11
  Uniprot ID: Q9UPY5
  ENST ID: ENST00000280612
  CDS Start-End: 281-1786
ggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcggagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactatagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatctgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagcctgaccaacatggagaaaccccatctctactaaaaatacaaaattagctgggcatggtggcacatgctggtaatctcagctattgaggaggctgaggcaggagaattgcttgaacccgggaggcggaggttgcagtgagccaagattgcaccactgtactccagcctgggtgacaaagtcagactccatctccaaaaaaaaaagattatatatatatatatatgtgtgtgtatgtgtgtgtgtgtgtgtgtgtgtatatatatatatatatatatacacacacacacacacactttttatatatatatatatatatatatagtggaacttacaaatgagagtaatataatgatgaaattttgaactgttatttataaacatctaaggtaaaatggttagtcatggccagagtatgtttcatcctttaatttttgtccatttgaaaataaggatttttgaaagaattataccaattaaaattattaaaggcaaacatagaattcataaaaaattgtccaaagtagaaatgatgacctataatttggagcatttccaattcagtaatttcaattttgctcttgaaaacatttaatatatatccaagactgacatttctttagctgaacctaacgtttgggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataaatggttagctgaaagtagaccttattcttgtccttctttagaagagtaaagatttgtcctagggaagatggctgacttcggttcccaacatgcgtatgcatttagactgtagctcctcagccctgtggacacaaaatttggacagcttattaggttacgttagcaatgcatgacggtttctccaacactaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagtcagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaaaaaaaaaaaaaaaaaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataa

SEQ ID NO: 184601 - DNA, 797 bp, Homo sapiens
  Payload ID: 16348
  Gene Symbol: SLC7A11
  Gene Name: solute carrier family 7 (anionic amino acid transporter light chain, xc- system), member 11
  ENST ID: ENST00000509248
  CDS Start-End: 1-228
gcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaccttttctgagcggctactgggaaatttctcattagcagttccgatctttgttgccctctcctgctttggctccatgaacggtggtgtgtttgctgtctccagcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcggagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaagga

SEQ ID NO: 184602 - DNA, 1878 bp, Homo sapiens
  Payload ID: 16349
  Gene Symbol: SLC7A13
  Gene Name: solute carrier family 7 (anionic amino acid transporter), member 13
  Uniprot ID: Q8TCU3
  ENST ID: ENST00000297524
  CDS Start-End: 105-1517
agaattattttatttcaggaatccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggcggggcatgctttacacttatagcaggggagctgaagaagcccagaacaacaattcccaaatgcatatttactgcgttacctctggtgactgtagtttatttactggttaacatttcctatctgactgttctgacacccagggaaattctctcttcagatgctgtagctatcacatgggctgatcgagcttttccctcattagcatggattatgccttttgctatttctacctcattatttagcaaccttctgatttctatatttaaatcatcgagaccaatatatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataaggtgtttttgtcatttccattagcaacaatagtcatcgacgtgggcttggttgtgataccattggtaaagtctccaaatgtgcattatgtctacgtgcttctgttagttctcagcggattactattttacatacctttaatacattttaaaataagattggcttggtttgagaagatgacttgctatttacaattactatttaatatttgcctccctgatgtgtctgaggaatagatgtcggaagtgcaaactcttaaaaaattggccttctaaaaaacatatatcagattccaaatcaaggttaaacatatgatagaacattcatggtgaaattcctatggtaaatatttttttctcaaatgaaataagtaatgtatacaaaagtgcctaagacagtacctggcttcagagtcactaagaaattgctaaaagctctgcttcgcatggtaaaaaacttaagtcctggtttgcgtagcttgatagagtgattatacaacttccattctctcactttttttttctgtatcccaccccttttctactgaatttgtggggatcctataataaaagtgaatgactaaaaattttaaaagca

SEQ ID NO: 184603 - DNA, 1618 bp, Homo sapiens
  Payload ID: 16349
  Gene Symbol: SLC7A13
  Gene Name: solute carrier family 7 (anionic amino acid transporter), member 13
  Uniprot ID: Q8TCU3
  ENST ID: ENST00000419776
  CDS Start-End: 84-1385
tccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggggagctgaagaagcccagaacaacaattcccaaatgcatatttactgcgttacctctggtgactgtagtttatttactggttaacatttcctatctgactgttctgacacccagggaaattctctcttcagatgctgtagctatcacatgggctgatcgagcttttccctcattagcatggattatgccttttgctatttctacctcattatttagcaaccttctgatttctatatttaaatcatcgagaccaatatatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataagagtctcattcttgtcgtccaggctggagaagctggagtgcagtggcatgatcttggcttgctgcaacctctgcttcctgggttcaagagattctcctgcctcagcctcccaagtagctgggattacaggtgtttttgtcatttccattagcaacaatagtcatcgacgtgggcttggttgtgataccattggtaaagtctccaaatgtgcattatgtctacgtgcttctgttagttctcagcggattactattttacatacctttaatacattttaaaataagattggcttggtttgagaagatgacttgctatttacaattactatttaatatttgcctccctgatgtgtctgaggaatagatgtcggaagtgcaaactctt

SEQ ID NO: 184604 - DNA, 7347 bp, Homo sapiens
  Payload ID: 16350
  Gene Symbol: SLC7A1
  Gene Name: solute carrier family 7 (cationic amino acid transporter, y+ system), member 1
  Uniprot ID: P30825
  ENST ID: ENST00000380752
  CDS Start-End: 388-2277
gcactgctgatgaaacctggcgccggaacccgccagccctcggcgcccattcagtccgcgcaggcaggtgtgagcagcgggtcaactacctggcaggcgcgcacgcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccatgtg

SEQ ID NO: 184605 - DNA, 547 bp, Homo sapiens
  Payload ID: 16350
  Gene Symbol: SLC7A1
  Gene Name: solute carrier family 7 (cationic amino acid transporter, y+ system), member 1
  ENST ID: ENST00000450494
  CDS Start-End: 183-547
gatgtggccagtggtgtggatgtgaatattcatccctgtggaggaaaatagtggggtctctgagatttgattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacat

SEQ ID NO: 184606 - DNA, 7560 bp, Homo sapiens
  Payload ID: 16351
  Gene Symbol: SLC7A2
  Gene Name: solute carrier family 7 (cationic amino acid transporter, y+ system), member 2
  Uniprot ID: P52569
  ENST ID: ENST00000004531
  CDS Start-End: 49-2145
tcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgt

SEQ ID NO: 184607 - DNA, 7557 bp, Homo sapiens
  Payload ID: 16351
  Gene Symbol: SLC7A2
  Gene Name: solute carrier family 7 (cationic amino acid transporter, y+ system), member 2
  Uniprot ID: P52569
  ENST ID: ENST00000398090
  CDS Start-End: 49-2142
tcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgt

SEQ ID NO: 184608 - DNA, 7622 bp, Homo sapiens
  Payload ID: 16351
  Gene Symbol: SLC7A2
  Gene Name: solute carrier family 7 (cationic amino acid transporter, y+ system), member 2
  Uniprot ID: P52569
  ENST ID: ENST00000494857
  CDS Start-End: 219-2195
ctccttctgcagcgcggccggcgggcgctcctcttcgcgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatatagaa

SEQ ID NO: 184609 - DNA, 7638 bp, Homo sapiens
  Payload ID: 16351
  Gene Symbol: SLC7A2
  Gene Name: solute carrier family 7 (cationic amino acid transporter, y+ system), member 2
  Uniprot ID: P52569
  ENST ID: ENST00000470360
  CDS Start-End: 118-2211
ggcgcgaccccaacccagccccacaggagactctctgaagaccagcaggaaagcagtgagcccttacagtcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatatagaa

SEQ ID NO: 184610 - DNA, 2274 bp, Homo sapiens
  Payload ID: 16351
  Gene Symbol: SLC7A2
  Gene Name: solute carrier family 7 (cationic amino acid transporter, y+ system), member 2
  Uniprot ID: P52569
  ENST ID: ENST00000522656
  CDS Start-End: 170-2146
cttctgcagcgcggccggcgggcgctcctcttcgcgggaccagcgaggcggcggccgctgctccagcgtcccccagccgcgggcccccgacgcgctgcagccggcagcccaccgccgccttcttggcgcgaccccaacccagccccagtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttata

SEQ ID NO: 184611 - DNA, 2235 bp, Homo sapiens
  Payload ID: 16352
  Gene Symbol: SLC7A3
  Gene Name: solute carrier family 7 (cationic amino acid transporter, y+ system), member 3
  Uniprot ID: Q8WY07
  ENST ID: ENST00000298085
  CDS Start-End: 151-2010
ataaggggcgcttggcgcgcaacgaccccaagccgcagctttgaagcctgagcggccgaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtag

SEQ ID NO: 184612 - DNA, 2236 bp, Homo sapiens
  Payload ID: 16352
  Gene Symbol: SLC7A3
  Gene Name: solute carrier family 7 (cationic amino acid transporter, y+ system), member 3
  Uniprot ID: Q8WY07
  ENST ID: ENST00000374299
  CDS Start-End: 146-2005
aagccgcagctttgaagcctgagcggccgaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaat

SEQ ID NO: 184613 - DNA, 1946 bp, Homo sapiens
  Payload ID: 16353
  Gene Symbol: SLC7A10
  Gene Name: solute carrier family 7 (neutral amino acid transporter light chain, asc system), member 10
  Uniprot ID: Q9NS82
  ENST ID: ENST00000253188
  CDS Start-End: 148-1719
agtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgtttaaggaagccctaaaatgtggactgggtttcctgtcttagcactgccctgctagctcttcctgaaaaggcctataaataaacagggctggctgttc

SEQ ID NO: 184614 - DNA, 1641 bp, Homo sapiens
  Payload ID: 16353
  Gene Symbol: SLC7A10
  Gene Name: solute carrier family 7 (neutral amino acid transporter light chain, asc system), member 10
  ENST ID: ENST00000590036
  CDS Start-End: 96-1265
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccagtgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaa

SEQ ID NO: 184615 - DNA, 1431 bp, Homo sapiens
  Payload ID: 16353
  Gene Symbol: SLC7A10
  Gene Name: solute carrier family 7 (neutral amino acid transporter light chain, asc system), member 10
  ENST ID: ENST00000592596
  CDS Start-End: 96-311
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagtgagtggggcccccaactgggccctgggaagcagccaggccctctggtgggacaggcagcctctccgcccagccccactgccacccaaggctcgggctggtcctcggtggcccacgcctgttgccctgcaaaaatggccctgggaagaaagccggggggcttgcattctagcctggccctgttctctctggctatggacacgtcacagccccttgcagggcctcagaaaggctgaatatcatcatcctgctgtaaatagatccagagatttgcatttggcctaaaattatgcatatacacacaatatggtccctacaaatgaagccaatgactgcgtctgatgctcggccagggatctcgacagtaaacctttgcagctgagcgagctgggactggaaagttccaggaagactctgggtctgtggactgggctctggggccattttggggaattttccaggctgattttggctgtatgcgattttatctttctgcacagacatcagaccctgtcctcaggatgtgatggggcccctcccccatctcccatcctaccagcctgtgtccaggtgggggtggggcagggcagacaacagggtccctgtgtctcgggcagcaatgctgccccctttcctgccccaacatccccagcagacacaagagatggagactatgagctgctctcgtggctgggtctcgggggtcctgcaccctcaggagctgacgctgacgcactccactgcctgtcacca

SEQ ID NO: 184616 - DNA, 789 bp, Homo sapiens
  Payload ID: 16353
  Gene Symbol: SLC7A10
  Gene Name: solute carrier family 7 (neutral amino acid transporter light chain, asc system), member 10
  ENST ID: ENST00000587064
  CDS Start-End: 96-311
tgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaa

SEQ ID NO: 184617 - DNA, 10103 bp, Homo sapiens
  Payload ID: 16354
  Gene Symbol: SLC7A14
  Gene Name: solute carrier family 7, member 14
  Uniprot ID: Q8TBB6
  ENST ID: ENST00000231706
  CDS Start-End: 317-2632
atctgaataattgaggagctgttcagcagcagcggctgcctcctgccttcctttgccgccaccaccacttcccatcccagctagagagacagctccgcgcagtaagtgcggactgccagccaccagccttggcagccagctcgtcgcctccagccccgaccccgacattcatgcccaggagaaggctgcactgggtccctctgggcctttcctaaaagggagatccctgttcactagatgagttccagaaccatccactaaggctttgtagcccccttccatcagctgaccttcactgcatcccctatcgctcaagatgagtggcttcttcacctcgctggacccccggcgggtgcagtggggagctgcctggtatgcaatgcactccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcaggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaacaagaggctatatgaaattccatcttaggtgcaaccaccagagctgatggtaccaaatgtttcctaggcctttgctttgctggttgaagcccaagcaggggctctgggcagaaggcagaatttcagtcacctgagacatggggacaaagctctgttcttggcatgtcaggctgagtgctgctccccgaggtcagggtgggtagatgggcattggcacttcctgagcaagcatcattttatcctgcaatctcacccaaaattaattcatggaaaagacacatgcttctttttattcaccaacattctcacagcttccaaactataattttaggatccagcaaagttcagggactctggaccattttcccaatggtttcagattcaccataaagcagtcaggcagacccagtgatatggtaagaagcaccatcaaagctctatgtaaatgcccagaagaaaattaaataaccatatcttgcggtaaaagccagaagggcattggcagaaattaactctctgtcatggcctctcttatatcagactgcagctcctggtgatatgatgaaagcgggcaaaggtggagcatgatttcatggcactgatatgccttgaaaaagtaggttgtttgttttataatcagataaaaatttttacaaggagaagtgagccagccactgagatcacattgcaaattctctttcatatttctaaaattataaattctaaagtttttgagataggcaaccacttgattggtgtgtgctactctgaaaacaaaataggctgaagtatagcgacttaggtagttgcattccatgagatcacatttcacttctgaaccttattccttggggctagctcactttcagaggtgtatttttttttcctgttatttcccagagtagtttcactgaagcccagagaaatatctacctggtaagatgtaaatttgggccataaaaggggctattaaaagaattttctcagaaatagaatagatgagagaatttgcaaaggaaaaaaacacacatgggctacaatataaattctactcttgggttacaagaattcctgtggctgcactgagatacgtacaaatgtatgtgaaggcacaatttgaatcaagctatcatagaattaaccaagctattaaaattaatcaagctattaataaaatctctgtgaggatttcctgaaagagggacaaaagaagaaattccttgtcctttctctcctggatgtatcagtatgccaaacgttttccagaacatattcgctagcactcaagtctgttctttctgaaaggctgaggctcatgccatcttggcatgctttaggattatggcaaggaggtaaaagtccattttttcattcaactaacactggttgagaatagacccaatgctaagtgacaggaatgaatagaagcatggcacttgcccttgggggctacagtccatggatgagcagcactggagcctggtaaatgcagataaaacaacaaacttgacaagtctccaggctgatgcactgggttttaacatacatataaagatgaattgaaactagtttttaaaaaatatgctttaaataaattacatatcgtaatcatagccaatgtataccattaaactaaaataactgcaattttctagatattttttattcttctgtagtcattgtttagaactctggtttcctgaggtcattttgtcattttaatatcatgcttgacaatgctatgttttctcttccctagagttaaccataaagatacagtgcctactctgtgaaatacagcattaggaattaattataaactaattatcagtcatcttttgaaaacaaagttttgaattggctataggactcaacaaatctgcctggtgtaaatagaatctgttaagcttgatacatatctagatagatgaggaggggttgtattcattaagcatgagaatagagaaataggagtgcaaaatggcaaaatcttaacgtgggtgaaagagcttccttttactagtgaggtttaagtattaaagtaacaatagcctggtggcagatgaatgcaatttctataggatgggaatggaaaatgtatgctttggttaacaccattgctgttgacttcatgcagattctattaagcactctcatttcaggagccatttttcccacatagtatattagtatattttaagcttagctccctttatttttctaaagttgataaatcacctccctagcaaccttagttttaaaaaaaaaatcactaagatagaaaaagtattttcaggtacatagacatgtttgtcctcaggtttacctgcttctgtgaacagtcccagattttacaatgcagttttcaaataccatcaatcactacaatgacaatattactattttcttaacaggtttctaaacgatgtatgtgtgggatcacattaaaagtaagatcaccttataattatcttagaaactttgccccttgaagggagtccaaggaagacctacattttattgaattctgaatagcaaaagctctccgagtgagatttcattgtgtggatttgtggtttggagccaattacttgattttcttcagattttattctacttatttattggtactctgcttcatttcaaaaggatttgaggcagctactaaaatatatataatacaaaacaaaaattaagtgaggaactcagagcaaacaaaaatagaaacagaaaggataagacaaaactagacgtatatttagtacataaatgcagaaccctgacatgctttactaaatttgccaatgagtgacaccatgaaaaataatagaattagtggtaatgacaagaagaagtacttctgcatgataagaacaaatctttccccatgcaggtagaggtttgaaatagcatagatcattaaaatccacaggtaagcttcaaacctagattttgctagctacatgtgcctggcatatagtgtgtattcaagaaatacctgatgattgacagaatgaatgaattggaggaaaatgaaatatttattcaacaattacttgtggagtgcctattatgtactatggcagatattgatatcgtaagtcagataaaaatccagctcttaagaagtagaggaaatagagcttggtgtggtggcatgtgcctatgatcccagatagttgagagactgagggaggaggatcacttgagcccaggagttcaaggctgcagtgagctatgatcacaccactgtactccagcctgggtaacagaagaataccctgtctcttaaaaaggaaaatcaaataggggaaatgggatatataaataaagaacaatagtgaatgtgtcaggtgagatgacggacttgtaatgtgctgtggggggtcaaatatgaagaaggccttcttcctctggaaaggtcataaagaatgtcacacttgtgttggaacttgtgaagtgggtagaattttatcaagtagaaatgagagaaaggcatgccaagcaaaggatcggcatgaataaggtctactagtttgtggtcctctggctaagaatttgtgctgtgcctccattaagagaaagcaaggagctagtttgcctggagcacatgatttatgcatgacttatacatgcaacaataagaaataatgctaggaaggcaggtgagggatcactcacagagagacttgaatgtcacactgagctgactggctttcctcgggtgagagagtgggaaataattggggaactgacgaaagtgtgaatccaggaaggctgaactttaagaaagctgagacggtggcttccttacctatgcaaggaactaacaagccacatatacactccaaattgatttaacaaattaaagagaaaaatagctgtactttgagtcctgtgtctgcattcatcattaacctaagaaaatacagccatttaatacgtggacaagcaacacaatttaacagccactttaaagttttcaacaataggtttcaacaactaaacctaacaactttttatatctatctaatctaaacagtaaaatctcagctccaggttttactgagcttgagtgctacttttttttttttagacagagtctcattctgtcacccaggctggagtgcagtggcatgatcttggctcactgcaaccttcacctcccgggttcaagctattctcctgcctcagcctcccaagcagctgggattataggcgtgtgccagttctacttcttagtaacaaactagtagctaatcaaatgcctacataatggtcatgataaatctgtttaaataaatggcgggcggaagggagttgttgaatttaacaatccatccttcttcagaatctataggtcagccagaatataaatctagtaattattgaaaaacaaaacacaaactccttcaaagaaatctctctcctctattctgctgaaaagggttggtaaacctgacatcctttcttttattggaagacaaatccaacatttgttagacatccaacatttgttggaagtctaccttacaagaaaccacctcttatctgcaacataaacagaagctacatcaggttgaaaatccacatagaagactggagaaaattgccgtcccctttcgcactaggttttaccaggggcccaagatgtcagaggaaagtccgcggagggccaaacacaggtttacctaattatgaatctcagattagaatgtcttattgtgtggaaaagtcagaactcaggaaatgtgtctgaagccagagcgggggtctgcttacggagtctacgcagcgggtaggggtccactattggagtataaacctcaggtcagtgagtagtgcagaggtgtccctaacttccaatggagggaaagagaggagagcaaaggaaacacatccagaagtcgccacgagggctgtgtgccagcgctccattttcatgctgtttggaacaagacgtgtcaaggaagatgtttctatccaaagtcttcatggagcctctgcttcccctgtacctgtgtagctccctgaaactgaggacccacgtgtctgcaaagacctctggagatcctaagagagagaggcaccagcaggtaaccagtggtggcctggccacgaaagagtatttgaaattcaacagtgagcaagtgcagaaacagcatcccaaaccgcaggccccaccacacgcaggaaccagaaagctgaagtttcaccaaggagtttacttagtatttctcgctgggaatggggatgggtagcaaaaagcccctttcatgtacataatggttggtcctatgtcctacttttattttctctaagagttttagaagaaaggctgttttaatttttttttctccttaagagcaacttcctttttaaaatgctttcctcttcttgtcctgcttgagtaatgcaggcatcattctgaaatcattctgaaacagctaggcagtcgccttttgccaaaattacttctctaagaaaatagagtgttcttttttttaggacttagaacccacaaggggtgagtggaagttttgtagcccatcaaaggtgaatatgtgttctgcagtatcaactaaaacagtgtacaaaatcattaaactgggccgggcgcagtggctcatgcctgtaatcccagcactttgggaggccgaggcgggtggatcacctgaggccaggagttcaagaccagcctgaccaacatggagaaaccccatctctactaaaaatacaaaattagccaggtgtggtgttgcatgcctgtaatcccagctattagggaggctgaggcaggagaatcgcttgaacccgggaggcagaggttgcagtgagtcgagatcacaccattgcactccagcctgggcaataagagcaaaactccgtctcaaaaataataataataataatttaactgtgttctgcacacacagaattacaaaatccctataggactttcacagatagctttgggcttaaggtcttcggacaacaggtagttctaatttcttactctttgggacatttagtacatgttggtacacataaggaaagaaaatggcttatattagagctaggaaacaggggcagcctggatttttatggtaggaactcactctgtgcttttttttttttctgttaagttttcttgacactgacttcggtaacattggctaaagggaattgtgagtcatgtgaatttcacctgcagtgcagactttaaaggactgtgttcattctgatttggggatgaagagaatgttccatgcacatctattgattggtcttggcagttgctgatacgcttgtctcattcacactcccaaaggcgaggatttaccctagaaatcataaacccccactttccaaagcaaagatgctgttaatgttatgatggtgcataaatacctcaactgtctgggctgagagagggggctgcaggtttttaagagagcagctatagtcctcattccatgtagtcacatcatctgatgacaggactccacattctagcttttctcactgtggaaaagaaacgttactgtttaattaatatccaaagttataaatacagcttgtaaattttactaacttgtttctttttcgtttcgtccttgagaagtacaacttgcatttacagatggtaattcctagtgttgttctctgctatctttttttggtatgaaattgctgtatttgttaaagtttgttcgttttgtggtttttaattcccattggtgtgctgtacaatgtagtgtatcatgaagaaagaaataatatgcagatgtattatgaaatgtgttttattttcaaatgtgtggtgttgacaatatattgatttatcaagatactaagggaaaattctaaatttaacaaaatgtgtatattttaataaatgcataaagctttattgtgtgcctttaaatttaaaaatgggtttataaagaaagtcagaaacaaaagtgtcttactataaaatatccatagtaatgtaaagcttttacacgagactaccaaaaaaaaagaaagaaaagaaaaaggagccttcccatattttgttaaccttaaccagtatctgaagtctgttactttttttccattcttaaatggagatgaataagtgaatttcgccttaagtgtttcaattgtcctttgtagaaaagccagataaatgagttcactttgaattgcattattgtggaaaattcattttcagaataaaacattttaaaaagta

SEQ ID NO: 184618 - DNA, 2313 bp, Homo sapiens
  Payload ID: 16355
  Gene Symbol: SLC7A4
  Gene Name: solute carrier family 7, member 4
  Uniprot ID: O43246
  ENST ID: ENST00000382932
  CDS Start-End: 69-1976
gcggaggcagcggctgcggcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgta

SEQ ID NO: 184619 - DNA, 2307 bp, Homo sapiens
  Payload ID: 16355
  Gene Symbol: SLC7A4
  Gene Name: solute carrier family 7, member 4
  Uniprot ID: O43246
  ENST ID: ENST00000403586
  CDS Start-End: 63-1970
gcggctgcggcagcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgta

SEQ ID NO: 184620 - DNA, 416 bp, Homo sapiens
  Payload ID: 16355
  Gene Symbol: SLC7A4
  Gene Name: solute carrier family 7, member 4
  ENST ID: ENST00000426145
  CDS Start-End: 172-416
agaaggtgggctgcggactttcagacgtggcccttaacctccccgaactgacctaggctagtcagtcagccggcggtctgaccttctccatctgtgactgagtcacagtcacagggcttccctagaccccggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctc

SEQ ID NO: 184621 - DNA, 4189 bp, Homo sapiens
  Payload ID: 16356
  Gene Symbol: SLC7A6OS
  Gene Name: solute carrier family 7, member 6 opposite strand
  Uniprot ID: Q96CW6
  ENST ID: ENST00000263997
  CDS Start-End: 20-949
gtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggagggtttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttgaaagaaaaaaaaacgttgaaaaaaggaaggtttctttagctttagcttcttggcccaggaatttttcctggcattcaggttctgtgctgaaaccacaagggagggggaggttcccatttcattagcagtaagcttctgctgtgccataccaccaggctgcctgcctctaggaaaaccctgttccttttgatagaatctaaaaggggtaccagtgggtcccttgtagcaatacagactggatagtaatggccattagggcagaaagtagtctgagcagtgggagattttagttaacagctatttctgcttccaaactctgataacggttgtgaaattactgactgacttcctttggcagtggggccaagaaacaatatatatgaatgtgatacatgtgtttagtaaaatctagctttgaacatggaagaaagtaattctttgaaaaccttttaaatctgaatatctaaaacagggagcggtagtgaaatagaaggttcagcattgattataaataccaaggacttaaggcaagggaggaaaaacaaagtaccttctgaacttagctttccactgagtaatgtttactcttcacagcacccaccacaaaaacaaactactatcaacaggatcaattttattaacaacttgtatctcttctaagcagactctgtccgtatgcctttccaaaccatagctgccttaactgactgccttggtgtttattctagcgtaacattgtccagtagaactatctgcagtgatgatatgttctgtgtctgcactgtgtagtagtagacacgggtggctgctgagcacttgaaatgtgattagcgcaactgagaaactgagcttttaattttatttcattttaatgtaattagctacacgtggctagtagctgttgcagcggacaccacaggtctaaggaaacaacacagaacattcagctaggggtgtaccctcatagcctgtgagtgtctcttactcactgtcatgggggaaggtgagttacacagggaggtaccttcttgccgcctcttttaggatttcctaagtatctctccttcatcctacctgccatcattctttgactttatgtccattttctaaacctttgcctacacttgctcttatctacatggagttgttcaacctgccgaagtgattaaattctgtgtacacaggccgtatatattgcagctaattaaaacaacaaacatcctaggcatgcacaaaggtataattcaccgttataacaggcagcaacttgtatgtctaatattagacatcttgctttctgtctgtaggcatagaaacaaaggattgaaagccattctcatacagcaaccgggtgaaaaaaacaaaacactgtgctgttacaatgtgctccctgctatttatactcattaagtttccccaatattaaagggctgacaacttaataaactgtactcactgcaaaagggataataagcacaccaggaaaaggatttaaggagacagacaacaaagagctggcagaaattaattccaccatgaagcttgagtgctgtagggatcctctggcttcgctcccaaagagaggatcctgggagaagtctgtatccagcacagaggggaaaaatgctgtcaccatccaaaaatgaaaggaggatgacatggctcactaagcaagtactagggcacctggcatgtgaggtccttgctttccctagaagccactggtggggggcagcaaattcctgggattagctggttatctggtggagaaagctaaagctggggtcagggatctttaaaaggcaagcacattttgcttaaaggattagctccagaggagccctgggatgggtgccagcttagctcagacagaagtcatgttcttagcgttcaggcaagtcagcctttgcataagacaccctgtcgtcgggcaggaatttgccgttacaaatcccaaacccatgacagtaggaatgtcaccccatgcttcacatatgcattatgctctgaacccagggcaactatgaccatgcttccttcaatctttattgagcaaatatatggccaaggttattcccttatctgtgactgggtggagaagaatggtcaggaagggagactgcctcactgttgaccaattccaaaacctaaggataagcccatggggtatgtcaagctagcaggttcttctcggcccaggatgacagtgtctgggggcatcacaaaacagttgtacaatccaatgcagccgtcctgctcatacagtaagatccattaggccagagcaggcctaacttgggtggagagcccagcctgagcaccagaattagttgcttccacttgtgcagcctgctgaagagccggactcaggttgaagcagctttcctcccagtcttcactgatctccacagggagaaaacagaagtccccacaagtaccaagctcttcctgagactgcagccaccacacctcggggaaggggaggctggcaggagaggagtacactgtcccggtgacccacaccaaggtggctccaagtgtaaacaaagcctggtgccagggacagaagaggatgcagcctgatgtgaggttttcagaaaagtgaaatgacctagcaccaggttgggattgcttgggtctgcacagcagtccctcacactgcccttacagagaggaacaggttatttgatgacttgggcccatgagatgttctccaagccattgacagctgagagaattcaggtgatccacctgaatatcagaagtttcagccctcttagagttcgtaacagaaacccagagatttactgtcagctagaacaaagatgtaaggtctcaagtaaaataaaggattgtccttcaaaacagcaatattaacagacttctgactcaggaatttgttcatctgtccttgctggacctgagccaagtgcttgtaacgtgatctatgatctatctgtatgctaaagtgtaacaggtacgtgagtaaaaaaatctttaaggttc

SEQ ID NO: 184622 - DNA, 706 bp, Homo sapiens
  Payload ID: 16356
  Gene Symbol: SLC7A6OS
  Gene Name: solute carrier family 7, member 6 opposite strand
  ENST ID: ENST00000561590
  CDS Start-End: 1-360
tctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccagaggacatttacgacgatgaagatgacgagaacagtgagaataactggcgcaatgagtacccagaggaggagagcagtgatggagatgaggattccagaggtgggtggcagccccagaccgggagggactggtaggatctgagactgaggtgcaggcatagttgacaggtgcatcttaattgcctttccttctctgtcattgagcgccagcagcccagccgcaactgagccatgctgtaggagacccaaagaccagtgtttcccaggggcctcctgggggtgtaataatccatcaggcctggattcaaatctgtagttgtcattactttgctgtggctcttgggcagttacttcacctcactgagcctcattttctctccaaatgagatggttctgcatgaattttagtggttgagattatgtaaaatatgtagctcattgtctcttcccctgccccagtcaagaaaccaatgaagagaga

SEQ ID NO: 184623 - DNA, 428 bp, Homo sapiens
  Payload ID: 16356
  Gene Symbol: SLC7A6OS
  Gene Name: solute carrier family 7, member 6 opposite strand
  ENST ID: ENST00000568315
  CDS Start-End: 1-118
aaaacacgatgactatgtgtatgacatttactacttggagacggccactccaggctggattgagaacatcctctccgtgcagccctacagccaagaatgggagctgatgtgtaggtgaatgatgatcaagaaccagaggacatttacgacgatgaagatgacgagaacagtgagaataactggcgcaatgagtacccagaggaggagagcagtgatggagatgaggattccagagctccaaggggaagagaagctgatacactcctcagacccactaactggcactgggtctcacttctgatccttctccttccttctatcctgccataaatgtcctacaggtttggtcctctctgtgcacaggtaaatattacacacagtggaaattcaactatgtgctaaactaatgaataaagaaggctgcttgt

SEQ ID NO: 184624 - DNA, 1187 bp, Homo sapiens
  Payload ID: 16356
  Gene Symbol: SLC7A6OS
  Gene Name: solute carrier family 7, member 6 opposite strand
  ENST ID: ENST00000619380
  CDS Start-End: 26-742
cccacagtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggagggtttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtgaatgatgatcaagaaccaggacatttacgacgatgaagatgacgagaacagtgagaataactggcgcaatgagtacccagaggaggagagcagtgatggagatgaggattccagaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttg

SEQ ID NO: 184625 - DNA, 910 bp, Homo sapiens
  Payload ID: 16356
  Gene Symbol: SLC7A6OS
  Gene Name: solute carrier family 7, member 6 opposite strand
  ENST ID: ENST00000568538
  CDS Start-End: 1-628
cgagtcagcggcacagaagacgtcggagggtttggagagagcggcggagaataatgtcttccacttggtggccactgtgtgctcccaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaaacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtaagggggcccatgagcagacggggcatgaggcatcctaagctcttaatctaatcagaatgctttgcttccctgggctccactcccgaacaacattgtccttagttcttttcctcctgaaaaggaagaaattattctaagtgccttttaggaacctgactttatagtacagggaatttggggaaagatcatcttagattgatcatttttacattaatgaatattttacaaggtttgcaacatcacctttattgtttatagctatccattcttaggggggaaatatgtatatggggcttatgataagataaagacgataaaatcagaaattcttaa

SEQ ID NO: 184626 - DNA, 2922 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000332839
  CDS Start-End: 1-2922
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 184627 - DNA, 20987 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000406785
  CDS Start-End: 191-3004
ggcgctgcacggtagtcagcccgccgccgccgcctgctttgtgcttcccacagaagatgggagcgacctcttcctgatcgggagctgtttaaaaggagggagtgcgccgtattttctactagcgtggaggaacggaggaagaatccattcacactccccaaaccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggtattattgtgcaactggtatcatcatccaaagaaaaaaacagacaccaagtattcaaactcttgcaaacgtcaacccttcggtcatgcaatgttctctttttaatgtcccaggagaacacagtgtcagaatatttgtctgtcctacagtgctgagatatatgttggacattcctccatttcactgattttttttacgttgcttagtatgactctatctacatcctttcctgcatccaggatcataagcccataaacagttacatgtcagacaactttttagcatgcagagtattacatcaaatcagtcgatcccaaaaaattccaatcccaaaattgatggtagtacagtttcttcccaaggggatgtttaagtaaatttctcttttagtttcatatgttatattcctcttgtagaacttctgcctcgcattaacgatttctgtctatatcttattaacttcatatatcatatagtcaaaacagtatagaaggaagtgatgtcagaaatggaataagcatttgtggggaaaaaatgtgacctctaaggtttgtgtacttatttgaagttgacatattagtggacttagttcttactataatagaatctgtccacatgtacaagtaaatgctactttattgatccgatcatctttaaaattttctttagtattcctcattatattctttatatggtcatatgtggtatactttcatgtatgaatgaaggaattatttaaatattttatagtatcaaactgtcaatatgtctcttgagtaccagcctttggtttaacacaaaatgagcagccaacctctatttctttatatagcaaaaagattaattcaatgaccagagctccttgaccgtctaacaacctttcagaaaaattctgtgacctgataattatcagtttcttacaagcaaattttaatgggttcaaatttcctgattccatccttcaaccagtgagtgttttataaaattttgctttttgtagttcatagcctaatagcactaattttttgttgcttttcaaacataaaatttttacaaaatattgttttagaaaccctgcaaaaattctgatgcatgcctttcccctgtggcctcactattaatgaaagctcaccactcacattgcattttccacaggggtcttgattcattggtgattccacagcaaaaggtccctgatcctaaactgtcaaaataaagtagcgagactgatatacatctgataactttgtggaagcaattagaaaattttctctggtagatgatgatgccctccatcctctaatagtggcagaactttgccttctcaagagaataaatcagcccctttaagacttcttttaatatttttgggctggggatatggagtctctctgttgattctgactttctgactatgattttgggcagttgcatgcagagcaagttctgagtgtagtttcataatctcaagaacgtttggccattttatgattgacagcatgtaatattggatctcacctgacctacaactggcattcagcttttatcattgtaatcacttcacttggccaaggcagttggtaaaactgagcaaagttaaatataaattccaatcattaaattggtgagtgcattatgcagaagatacagaatcctatttcagaaaaagaaacatgctattataagtggattccttagattttgttcagctctacctacggagttttgctaatagaatgtagttctgctattcttttttaccattatgtactcaccacttctaaccatcttgttgtcttcccatcacgcagtacatttcaaaatgctgggcggtcccgatggtattacacccacaaggacagcataggaagggtaaacaattgaaatagatatttcatgttgggagcttaattaggccatgattaatcgtctctcaaagcagagactgtcttatctataaaaggagcaaccactgagaggtggaactcccaaaggaaagcactgcaggtttccagcccacaagaaatggtacgtatttcactttctttgactttttccctgcctgtcaagatgtccaaatgtactcagaggctgtccacattttcagttttgtcaaaggttctctgattcaattttgtaagaaacatttaaatcagtggttatgtaaattattgtttattttgttttacttttaggaaagagcattactgtataacttcaaaaagcaatatgacttagtagttaaaattatgacccatattttttcaggaagacttgcttgcccaaaattgtcttgtctatctgttatcaatgtagtcattcatagctgcctcagtggttcacattttttagaattatgcttccctagcattttttcaaagagttggagagttttccccatgggaataaacagtcttaatatttcctttccctaatttcagcctttgcagttcttcggtgactactcccattatatccaactacccttagtgatgctcactattacctcccggcaatagggaaagagcttatgctataaagtgattgctcaagacatgtttttctgaaagtgaacttatcataggagaaatcaaatataatgacattccacctagataagagtcactaggacatagtatggaatctttgtaaatgagcgggacagatcatacctacagttacacatataatagtgttgtttattttatacctcttgaatcatatttattatgcttcagtgctgcccatcgacctagccttttattctatcaatatgtaggtgtggattgggaatgagaaccgacattcacatccctgatgctcatgagggtttctacaaaggtggagtatgtaaacatagaaaaacgtaacagatagcttccatgcctctaagaaatatgagtgggtcaaatgcttctctgtgggtactatttttctgctatgcaaatggtagaaaagttcacattaatagccaaacagaccaagagagaaattagctaacttcactgttaatctgtctactttgacagttaagatatagcccagccctcctaatttgttgactgcaaagacagatacgcctagttaaatccaagaatgcactgggggacggggggataaagttactagaataattatacaaccctccgtactaagattgcttattcgccaagaagaatcctgcccagagattttcagagacatttccttacattcccaaccttcttttaatttacacaactttttaattagaccccttgaagccacatagtaaaacaagagatgaattatctaaggagaacttttggccctccctctaatgtgaagatcacatacttgactgtatttcccattctttccaaatggaaagaacagtccaattaagtaaccaactatgtaaccactttttgacgtaattccacctaaaaaacaaagagtgaactaaattgtacaaacattaaacctaacagtgatatgaccagatggctagttttgagaaaaataatattttctgtagataccttgctctcccttcctgtactcatcctaatgctcaagtttgagaaatactccaaggaagaaatcttgaaagattgtacattcaaataatgctcatgtaattgagtaatatggcatttgggatgagaataagagcgtatttaaaaataagagaattggcacaaaaatgtgttaactaggattttattacaaattgccctaagatatttgcaagttattatatttaagtgaaataaatcccagtttccagaaacaacagtacaatttatattcgcaggttttatatgaaaatcaaagttgggcatacatactttttggctttggcaaccaaagaaaagcatgtttttggcacacgtttccaaattattgagttatttgtagaatacattggacctgtacaggtatctcattaaaattaccttcaataatttccctttcttcctttaagccatcaagtttctaaattttacaacttcacagtttagcaatttcatttatgaaaggctgattccattttgatgttgatttttacatttcagaatttttcatatataaatatttgatgcattagatgggatactgagcttgagtctggcccaaatgaaccacaaggcccagactgatctatcagtagttagaaggcttctaatacactggctttctaatgtacagtaaatactagcgttgttttcaatattctttcttttgactaaaagtttccattccaactggtgaaaaatttttaaaaaatatttataatgatagttagagaactgtttatatgaggatcagacattgtttcagcactggatctcctctgtcccctctcttgctacagcatacagcccagagacacacatgtaaaagtaggtgatctctgtaaacttcagctgcatttctgtatgtctaggattgtcctagtatcagatatcctttgagaaagagttggagaggcatggaaggaagcatattcctgacctcccccctttttagctaaagatacaaattcagagctgtttgaaaagggcttagaataatattaattaaacatattctataatacaaagagaagtacttttttaaaatacatttatttttctttcttttttagcaggcatttctgacagaaaatctttagggccaattagagtttctttctgacttttaattgccctctgccttttgggaaagtgttgaaaaaagctctggaaaaaaatatgctggtcaaggtcgaaccctggggaattaaaaacatgagatttttatattttccctccaaacatagcactgagcaggcaggttcccatgcctgttgttaatcggcattttcttttttttttttttttttttgagacggagtctcgctctgtcgcccaggctggagtgcagtggcgggatctcggctcactgcaagctccacctcccgggttcacgaatcggcattttctaaacacgtgttttggtgtgctgggagcagaggagtaggaggcccacccagtcccaccacacataccgggacatctttgaccacatgggtcctctgccgttcgtattttagcttagatgttcttaactgaactaacttccaattttcatatacactgatcatcttgtccctagcattttccctccaagatcctgctaacaggcaaactagccctttcaaacagttggtacctgagatttctcagagctctcttatcaagagtaaggagtgagattgcagaaggggcagtaatgtcaataccaagttattggaaactacttaaccagccactgcattacatactggagcccgtctaggacacttgcccttggaaatggtggaaagactttgttttatttctatttcatcaacagaacttttgtagcattgaatctaagcaaaggataacatcatattataatggaaagttatttttaactacaactgttattgttaaatttagaagaaaatattgtctttgaagtttcagtccaaaactctaaggagaacaaggtttttactgccatcggtaatcctgtgagaaatttgacactccagatcttatttgagacagataagtctatgataaatatatgtatgagacttaaaatattcttgatattctcaggttgttctcacaaattctgcatagatttagttgtttttttttttatgagaacctttcttatcaaaaaggattgaaaatttttccaacaactggttgttaaatgagtctagcacccaaagaagctgtgagcagttggttctaccagtgactcttctaggagctctttccaggttggtctcgaactcctgacctcaggtgatccgcctgccctggcttcccaaagtgctggtattacaggcatgagccactttgcccagcctgatagttctgactcaatccctagacacattcttcagaaacaactgtacatggtgagagaaaagtgaaaaggaaaaaagttttccttccttcaaaatacactaaatttgcttatcacctttaaaatttggactgaatgtttaaactttaaacacaaagcaaagggagatgctcttaaatgtgaaatctgaagcaaagattgcatttttgcaaagctatccagaagatgtgttaattattgagacatgggattcattaacacatcagcgcccaaccactgcctctcctgcccccattcacacattatccacaatcaaataagcagctaagcaggggaaacctatcactgttaatgtcataatcacatcaccactgaattaccagatgtggtcaggaactaggcaaagtaggtgggaccaatcctaggactggggccataccacaacctcagctcagccccttgtcggatacggtttctgaatttagtacaatgccagaagtattttttttctttcagctgtgaaccagcctgttttgtttgacaagcctttccagattcatgcagctcaatcacgtgcttgttgccagtttgagagtgaacctattatttcaaacttgttgccgtgaccaatttttacaaaactgaaagtagcactgtgaggtggattggacctagtgatgaggtgtctacacttgcatccttttcttccaagagaatattctgacactccaactctagaagtcatgtcattagtaaaatgaaaataataattgcttaatcactgtttagaattagttcatacttcttcagagcttgaagcctccacgactcaacatcagatccatggatagtattactatacctttacccaaagactggatttattttgtaaaaatatcagaatgggtctgggtccctttaaagcaactgacaaggtatttaacaacattttaaaacaatgaagaaaggatgattctgcagaggctgctgggttacagaggagggcagagcttttgtcagactctcttgatgttttgctcttcctggtaagtttttatctatcatggttcccagtggaatattctccatacacattctgtgggaggatattgacatggctctagactctgccttttattttctaattctccttggagaattagaacaggcattccagaacttgtaatatagaggggaagaaagaaaaaatggcagatgcctcattgatggatccacaagttttgtacaaaagcacacaccattctgattgtctctatattaacattgtactcaccaaacagctttctaaaggtgactggaacaagataaatatcaactggataattacctaaggaaaaagaataaaaaagaaatcaaaccaaaaaaaaagcaaaaaattggtcagtttagcaagcgtgttttccaggatcataggctcataaactatacagtcaagagagtgaaacaattttaaaatcaaaagttagagccttttatatttcttcagatgtacaatttcataaatcaagcatttattttgtgcaaagtattatattaggtaccctaaatggtatataaagaattcaaaacagagtaatttaagaaaattaacactagtctttgatttagtcaggaagagtccacttatggcattctaattaaattaaccttccattttggtctacattttatcaatttgagattgcttaatggggccattttgaaacctatcaagaaactttcctctaacagaaatagaaatattaattttcttaatttcacattctgtcttccactaataagataaatggattcagacccaacacacacatccagagattaccatgagccaagacctgtgtaagtttgatatagggtcttttattcaacatttcaagttgggaaaatcttattacaaagatcatttgcctcaccattgctgaattcttttactaggtgttgatgctaattcatcactggattttcttaactctgcctgttgctcttttggactttgaggcatgtggttctatttcagtgagttacaactccagctctcatcttttaacagcaaactagagaacatctcactcttcatctctgaggacacagtgttctcttcattttaacatcaaaaagtcaccagagagaagacccaaaggcttttctctttggaaaaggaatctttaattgtttcagagggtgaggaatcttcagctctctctggacttgattgtcctcatcattaaatgggaagactttacctttagcttgattttccagaacacatcaagccccgtatggtcagtgtttccctgttatcatccacttatgtgtatgggttgaaggtactttaagttgtgagccagctgctgcccatattgggtcaccaatgcacttgtcaagcccatgtaaccacatgaagtttgatagaaatataaacatttattttgaaataattccatgtgcacggttggaaaaacagtctcccttccctgagaggaatgagtaatttctcccttttcaagaagtgtacagtagaaaatgtaatgagattggaatggattccaaatcagtgacctttttaaggctgaaaccactattttaaatgaaaactttaagttcatacagtttcttatagtaattctacttttattttttagtcagtgtgcttaatcttttaggaaaaaaaactaaccagttattttttactaaagtatgtgaattacaaacaggatgtgcaatgaccaggcagaaagatatttaaaggtgtaattattctaaaggaagatgagaaaaaattcatctgctacagattcaactgtcttttaaatgcctcccttgtcatggagtaaatgactactcaaaaggatttcacaaaagacttaaatctcacccttagcaatcaaccggtcggccacagctcagatgcctcattagcaaaatgaaattgcacaacagacgaaacatagcaaaagaatgtagacatttccatggggtggaagaaaagaagaaagaaaaagcaaccatagtgaactctgcttgcataaacaaagaatgttttagtggaataaatgtaagctttctcttgaaggaatcccagttagaatgtcattggaaacggcaaaactatttcagcttcatagcagtaatatattccaactttattaccactgaggcacaaagctaaatttgtcagggggaaaggtaagcaaaaattactgacattgcaaccgataaaatgatcttgtgagactcaatattgagaaagaaaattaaaatagctaatatttctgttataattccagtgattactaagacttctgccaagggataaaattacttttccttctctcattataaatttctatatagagctattttaatgcagtaaggactgtattttcatattttaataaatccctcacgttgaatttgccccccatttcagatttgattaggaaatactaaattgagaaggcaggtttttccatctttttaaaaacaagtatgcaccataagcattttcagcggatgtctgccttaagcaatcttggtagagctgtcaatcagtggcaggtgcttgtttaaggaagagaacctgtgaatagatttagcctttcttcctcacagacagctgctcattcacacacgctcatctcgtcttcctcaacttcttgcaccaatcccgcctcttggattgacccacatccacctagcagttgaacaaactgcagattctaattacatgtcccgacagttgctcaacttaatttttcaccaactgaatttcatgcattgccccttgatgttccttccctctgttcactcttttctataagtccttgcatttgatatactttaaaatggatttgactaggaaaaaaaaaaaaaccaagtcagcaaacccttgtgttcattcaagaaattgtgaacaaatttagctgttatggtaataatcctgaggtgagagagaaaatatcacctaggtgacaagagatcattttaacgctattactaaaatagtattctatgaatagaggccatagaattttctacaaatagacttgtagggactcacattttgaatcatattttacttataggtttgctgtatatactgattaaacttctgaacctaaagattctctataattaaactagcacaaatataatctgtcccttacccacattgtaagaatgtctggtgggggaaatccaatattgaccttcacattccacatggaaaatctttgtccccagagtgcaattagggtgattaaaaataagccgcttttgtgagtctcaagtttgttccccaaacaagcagcatcagcaactggaaatttgttagacatgcaaattatccagtcccacctgagacttcagcccagatctatgaatcaaaaattttggagtgaccctggcaatatggactttaataagcccctaggatggttctgatgcatgctcaaatttgagaatcattgatctatgacacagcattctgagtggccaagaatgaacaatgtcacccactgcttaattatgctttcccttaagaaaaggtttaaatgcttaaaaggtaggttctttataaagataatgcattcagatatatgggagatatgtccaccattcagacttaaaatataattttaagggacattaatccttatgtctttttctggcataactgagtctgaggcagcctctccagtcagagatttctaatcagcttatctagttcttttaaaaccccacagctgatctactttgcctgacttccccggggcctagaaaatgaccctggacacctttctctaactgattagctctggctgatttgtcttaatgctaaaccactgtgtaacagtactaaattatacttaatgacacagtctactgttttgaagagtgctgtgtatgactgactgagctaaaaggattgctggctatgagtgagttttagttttagaattcattttcaaagactcacaaggctcaagaagcttgaaaaccacagatgatgtatacagtagctggagttccctggaggctcctttctagggtctctcatttgaattggtgcagaactgaaagcagagagtcagaaagtaactctgcttgtaaaaatggcttaggaaaaggaacttaagattgtgggttatatgtgtgtatgtgtgcacacacatgtatgtttcctgaattctaacctgaaaatatcacatttgtggatacttaaaatactcatatgcattttgatacacaaaagcaattcaaagtatgtaaaaggaggctggaaatgtaagcttaacagtgatattctggagaaaaatgttgtaactgtcactccaggcctcccttaggagaaaccaaacttgtcagatattttggaatggtagctctttttcaggaattagaataactgaagtatgatactgtgttccgtgtgctttaaaatctgtgaccctcccctgttgctggtcatagcttcagcatttgagtgtccattgtctgtcgctgaggacattttctcatcggctcttttccccattgtcccattcctctcactcacacctgattaccaaatagctctaacgaaatcacagtcactccttcctgtgtttccaccattgtgtacatcttcatttgcacaccctattttttaatcaaagttaaagcctcaccaacaaggtacttagaacaatcacccacttctggccacttcgtgacgggaaatacatctttgcaggggaaggagctggatcagactgacagggtttcactcagactatttcaaacaatgaggagccttgacctcattcccaacttttgccgtccatagtggttgatttcttgttttctctttctctctttttttaacagaaactcttaagctcaaggctaaattacagtggggacttgcctttgtctacagtccatggtttctgtattggctcaagccttgaaatcttgaaacaagcctaaattaaaattttctcttagcttaagaaaaaaagttacatattgtcaagacccttatgtgtgtggtccattaaaaaggtcttgatattagaagataacagcaaattgtttcttatcccacaacagctttgcctttcagtgtcctttgtggtggttttcgtaggtcagtggtacaattcaacactcttccaataagccataataataattgttggcacaactgttattacaacaggacttgcctgggttccatctattaatttttacagacagtaggaagctcacaccgaggagacattggtaacttcctggacaagggcaaagaaaggaactagcatattgtacatactgtgtacgtgcacagaacactggtctgtgcctttggagtgttctcagaggggcaggccagaagggaggattcaggtaggaaatgaatctaggacttctcttgcctttgatggttactgatggcaattgtgtttcccactgaataacttggtggacaattttgatagtaaactgaactcataccgagcaagcacaatagtcaatccataaagaaaagggtggcatatcataatgccagaaaccttgtctccctaagaggtgatcatgaatttcctatacagggcaaaaaagggaagaatagcctattcatattctgtattcacagtttgaaggacccatcacaaatgaccttcaaagactgacagggggcaggtagaagggaggcaaaaatgcagagaaaaagatgttaccttgaaaaatgaagtaagaaatcctaatattcccgtagttgatcctaaagtttgttcccatgtctacggttatttctaaataacttcactacactttgaaattccttagtggtggtttatcagtaatacttaactgaatttttccgtttctattctttgctgccaatgaatgtaatctccacgacttgccgttcgagtgcacgcacagacacacacacataatggtatatgcatcatatattactcattttgtgggaaacacaatgtattataatgaaaaagattccagcacattctttcagtgtgtttcagtgataaaattttgtgggggaatagaggtatacatactctctttgctgaccatattgttgaaattatgatcttaagcaacactgttagaaatgcttgcataaagtatcttctctagtattaatgagttgattcactctgaattgaaggttcaaaaaaatgcactaaacaaatatttttatatctgtggtattttcctattaactactcttagtgaacacgtgaccatatacctgatatcattaaaaaggaaaatggcctaaacgaaacgttaaaagtggaggtatttataaagtcttctgccaaagaccattgtttaatgatctgtaaaatgtagattatcttcttttattatgaatgtgattgtaagaaacaccctaacattctctaacttttgaaaatgaatattttgtatttctaaggaccaaggaaaatattttttaagccaatgtagtacacagaagccttgtaaatgagaggtacaatgacttggatcaactgcataatgctagattagaattccagcatttgatgataaatttatcaatctttcctataattcttatactgcactaaattacattttggaaattttagctaatcttttcaaattaaaggcaccaacattaatgacagatcttctctaatatgaaaagcatcaaaacattccctttcaagcactttgaatggatgaaaattgccatataattttcccacctacctaaccattccatgtaagttaactgagcagtctaacaatgttgtacagaaggttgacagactatgtgcaccaagaatatttaagttgtgcagttagcaagaactagccatttcaaatatactcaaatgttttgtaaataaaaattttgactcctataattttgttcaaactgatgtcttttaaaataattagattttatttgaattttaaaagtaatctgttgtaaattagatgttactttgttgactctgtgattcaatgtacactcagccatattcctgtggggaaatatcaatcttactgactttcatggcatgagccagagattcatagtttcctttaggactataagtatgaagacaaaacacaccaaaataaaatgctagtgaagaaattagaaacctattgtataaaatgtatttttaaaatcttaagatatatgtgatttacactgcctgttaatctagtctctttgtgattaaaaaaaaacataatatttgttaagactcagacaccaaatatttgtgatgtttgtatagcaccatcgttatatgtgatttcaaagggtaagcatctctgtcgtaatcatgtaagcccacagaagaataaattcctgaggttatgtacaaccaactctcagaattcagacttcctgcagctgccatatcaccaataaatgagaattgtgaaaaacaatttttaaagaattgagtttatgatcactgtgcattttgttaatgaatgatttcagagttttatttttaccagaaatgctctcagccagtaaacacaactgctgatttcaaccatactatcatttcaatggtttctatattcttgatctaactaccaaaaactggaagcttgttgcaaggtgtgtcctaacaaacatacaataaatgactcttcctgcatgctgcctgagatatgttgtaatttgaaatgtcttatcaaaaaattatacatgttataacccaaagttgaactggcaatatttttcatgtgtaaaattgatggtatgttaatatcaaaagcagaagcattgtttgtcatacatgtatgttatatgtgatgtttaatcgtgttaaactgtaatctgtgaagttttcattgcctgaactagtcaattctgtataaatcattgtcttaattgttttcctaatcttaccatatttcctaacactgaaatataaatgtttgtcaattagcca

SEQ ID NO: 184628 - DNA, 3178 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000403092
  CDS Start-End: 35-2956
aagcttgacagaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgca

SEQ ID NO: 184629 - DNA, 2898 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000408028
  CDS Start-End: 1-2898
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 184630 - DNA, 3065 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000402441
  CDS Start-End: 112-2925
ctttctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactag

SEQ ID NO: 184631 - DNA, 2965 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000405269
  CDS Start-End: 149-2962
tcttggttgctctcaccatgtgatacaccagctccacctttgccttctgctgtgactgtaagtttcctgaggcctctccagaagcagattctagcaccatgctgctcgcacagccttcaaaacttaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaagg

SEQ ID NO: 184632 - DNA, 3139 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000405901
  CDS Start-End: 25-2931
taggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggca

SEQ ID NO: 184633 - DNA, 2814 bp, Homo sapiens
  Payload ID: 16357
  Gene Symbol: SLC8A1
  Gene Name: solute carrier family 8 (sodium/calcium exchanger), member 1
  Uniprot ID: P32418
  ENST ID: ENST00000406391
  CDS Start-End: 1-2814
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 184634 - DNA, 3434 bp, Homo sapiens
  Payload ID: 16357
  Gene Symbol: SLC8A1
  Gene Name: solute carrier family 8 (sodium/calcium exchanger), member 1
  ENST ID: ENST00000407929
  CDS Start-End: 1-1995
atgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaaggaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaa

SEQ ID NO: 184635 - DNA, 563 bp, Homo sapiens
  Payload ID: 16357
  Gene Symbol: SLC8A1
  Gene Name: solute carrier family 8 (sodium/calcium exchanger), member 1
  ENST ID: ENST00000455476
  CDS Start-End: 303-563
atcagtcgtggtgactgccctggttgcactgtaagtatggggggacgtctccacgaaaaaaaactaactttctgccttgtgctctgcaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 184636 - DNA, 561 bp, Homo sapiens
  Payload ID: 16357
  Gene Symbol: SLC8A1
  Gene Name: solute carrier family 8 (sodium/calcium exchanger), member 1
  ENST ID: ENST00000448531
  CDS Start-End: 301-561
ctttctggtaaatttagagaaggcatcatactgggatcttttttcacatccagcccatgcggactgagcagccaaagcttgacagaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 184637 - DNA, 583 bp, Homo sapiens
  Payload ID: 16357
  Gene Symbol: SLC8A1
  Gene Name: solute carrier family 8 (sodium/calcium exchanger), member 1
  ENST ID: ENST00000417271
  CDS Start-End: 364-583
agcgacctcttcctgatcgggagctgtttaaaaggagggagtgcgccgtattttctactagcgtggaggaacggaggaagaatccattcacactccccaaaccagggatgtcatggtctagaacacctatgctgaagtacaaggctgagcaagaaagatcactccactgcaactgagcaaagtgctgaaggagttgaaaggaagaagagaacattggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggaca

SEQ ID NO: 184638 - DNA, 5234 bp, Homo sapiens
  Payload ID: 16358
  Gene Symbol: SLC8A2
  Gene Name: solute carrier family 8 (sodium/calcium exchanger), member 2
  Uniprot ID: Q9UPR5
  ENST ID: ENST00000236877
  CDS Start-End: 397-3162
acacaggagcgccctccggtgctgtcccctgcctctggtgctgaacccggaggctggggaggaggctcgggctccctgctcccccaggcccctccccgggcctccccccgcctcccgcaccgccttccctctgcccgcctccgcctcctccccctctctccggctcctccccctccctcgctccctcgccgcctccccctcccccgtgtccctcccctctcctcttctcctccctctatcccctctccctcccctcctccccggctctccctctcagtctcaggcttttctctctctcaatctctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattcgtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcagatccta

SEQ ID NO: 184639 - DNA, 3603 bp, Homo sapiens
  Payload ID: 16358
  Gene Symbol: SLC8A2
  Gene Name: solute carrier family 8 (sodium/calcium exchanger), member 2
  ENST ID: ENST00000542837
  CDS Start-End: 142-2175
tcaatctctctctctctttcgggcggagtcgcccaccactgccagcccagcgctggggggacctgctccaggctgtagccgcaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaa

SEQ ID NO: 184640 - DNA, 570 bp, Homo sapiens
  Payload ID: 16358
  Gene Symbol: SLC8A2
  Gene Name: solute carrier family 8 (sodium/calcium exchanger), member 2
  ENST ID: ENST00000597014
  CDS Start-End: 136-570
agtctcaggcttttctctctctcaatctctctctctctttcgggcggagtcgcccaccactgccagcccagcgctggggggacctgctccaggctgtagccgcaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtg

SEQ ID NO: 184641 - DNA, 581 bp, Homo sapiens
  Payload ID: 16358
  Gene Symbol: SLC8A2
  Gene Name: solute carrier family 8 (sodium/calcium exchanger), member 2
  ENST ID: ENST00000594353
  CDS Start-End: 104-581
tctctctctctctttcgggcggagtcgcccaccactgccagcccagcgctggggggacctgctccaggctgtagccgcagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttct

SEQ ID NO: 184642 - DNA, 2916 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000216568
  CDS Start-End: 328-1224
gagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagaggaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttc

SEQ ID NO: 184643 - DNA, 5250 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000356921
  CDS Start-End: 755-3520
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 184644 - DNA, 5259 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000357887
  CDS Start-End: 755-3532
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctac

SEQ ID NO: 184645 - DNA, 5268 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000381269
  CDS Start-End: 755-3538
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 184646 - DNA, 2622 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000394330
  CDS Start-End: 240-1094
cgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggc

SEQ ID NO: 184647 - DNA, 2840 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000528359
  CDS Start-End: 63-2840
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 184648 - DNA, 5146 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000494208
  CDS Start-End: 755-2617
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 184649 - DNA, 2837 bp, Homo sapiens
  Payload ID: 16359
  Gene Symbol: SLC8A3
  Gene Name: solute carrier family 8 (sodium/calcium exchanger), member 3
  Uniprot ID: P57103
  ENST ID: ENST00000534137
  CDS Start-End: 63-2837
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 184650 - DNA, 3409 bp, Homo sapiens
  Payload ID: 16359
  Gene Symbol: SLC8A3
  Gene Name: solute carrier family 8 (sodium/calcium exchanger), member 3
  ENST ID: ENST00000533541
  CDS Start-End: 240-872
cgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccaggtgagagtgagaggtgcttgaatttgcaaagaggattttacctggttcaaatgacccctggactccatctcattatcttccacaccatctcagatctgaacttaacagagcctctgcccttaaagtgcacaaaagtcaatcaaagagatgaataatgacattagtaatgacagctaatatttcttgagcactttcaatgtgacagacaccatgtgtgttcagcaatttacacatttacattttccccctgtaatgtttcccaaagccctattaaatagggtaagttattatccccacttcacagacaaagaaactgaggcccacagaggttaagctacatgcccaagtaagtggtccaatttcttaacctccacattatgtgagtagaccacaaacagtgaaattaaaagaatgtagatattgttctccttctatttacctctggcgatctctgagaggttaaagattagccagctcaaagatatcaaaggagaaatgcccacatacattcttggcctcctctacttggaaggacactgtgagtacaaagtatctcctagcaggacagccaaaggaagttccacagcttttatctttttataggatgaattacatactctttctttttcttaggaacactcagagacaaacagaaaggagcggacattcctttactcattgaacaaatatttactgagcacctattatgcctgttacagtattgtgctagtttttgggactatagtgaaaggcaagatacacatgcttccttctccacgtggagtttataatctactgaaggaggcaactctcaactactgtaattaaagttatcttgttaaatcctaggaagaaaaagaaaaggtactgcatacggaaggaagttgggcctgaatgtaggagttagcaggtagacaggggctgcactagcccaggttctttacttaattcagttaggggctttggggcctctgaactctgaacttctgccagggagctggcatcccagttgccccagaaagaaacagagcacatcctcctgcagggaagttaggctgaatctcatcagacaggacttttctggctgggccaagggaaatctttcctgtaccaagcaaacatatccttcaagagagtagctgaattcacatcaaattctaggaaaacctctttccaaaaccccagcgcaggccagcggtattatttgtccattagtgatgcaagagatttagctatcgtggaaatgcatcagaaggttggaaattagatggatgatcccaggaaggcctgtggatgagatgccctgtgatctctgttctccaagccttgggggacctgaactatcagaggggagggaggaaatatgggggaaagcatagaggtgggaagaaatatcagaggatcagaagcaaaaaacaacaataacaacagaaacaaaaacaaacaaacaaacaaaaaaacaaggccataggcaagaaagggtaagaggttttctctgggagatctaaaaaaaatggcaataatgaggtaagccaggcagatacctttgggcatctccaagtccttgcaattggccaagacaacagctaacaacatttgaggctttaagaaggttaccctgtgatccactcatctgatttagtggctttggctgaagctctttggatatagttgaaggtatggaaagggtccttacatgaggactttagggtcaagtctcttgctaacatcctatgtgaccttgggtaaattctttgacccttatttttcttacctgtaaaataaaagaattgggctagatgtctctgacagtcctccctgtatctacaatctgtgccaagatctaaagtcaaacaccctgcaaggccctgtgatacatatataaaccacaaagacagagccccgtcttccttgagtccacagttcaccctgcatgtccccatcatggttccccaacatgtcctctgtccccaaaatccagcacctcacccagtgctcaatcagtaggcattgctcaataactgttggtggttcgtgaataaatgccccatatgacagttaaaatcaggcatctactccaagcagcttcccagggtgtcaaggttccctggggagatattatgggatggcaaacttcccttactgaaaaagtagtcaaaggagaacaataagcccactcagtaaatatcagaactggaaagcccttcagaatctttcagatcactgcagatgaggaatgggaagcccagactagggatgtgacctacccagggccacacggcttgcttgcggcagaactaggagttaggagtggccccctagcccttgtctctcattcctgggttcagcccaccagctcaagctgctttttgggcatactggaagacaagccctgcacaccttagcctcctaccagttcccatgtgtctttgtccttttccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgc

SEQ ID NO: 184651 - DNA, 2975 bp, Homo sapiens
  Payload ID: 16360
  Gene Symbol: SLC8B1
  Gene Name: solute carrier family 8 (sodium/lithium/calcium exchanger), member B1
  Uniprot ID: Q6J4K2
  ENST ID: ENST00000202831
  CDS Start-End: 211-1965
cagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgt

SEQ ID NO: 184652 - DNA, 3289 bp, Homo sapiens
  Payload ID: 16360
  Gene Symbol: SLC8B1
  Gene Name: solute carrier family 8 (sodium/lithium/calcium exchanger), member B1
  Uniprot ID: Q6J4K2
  ENST ID: ENST00000552014
  CDS Start-End: 517-2271
cgaggttcggagtttgctggtcccaggcccggcccgagcaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaatttcaagtgtagagaaaa

SEQ ID NO: 184653 - DNA, 647 bp, Homo sapiens
  Payload ID: 16360
  Gene Symbol: SLC8B1
  Gene Name: solute carrier family 8 (sodium/lithium/calcium exchanger), member B1
  ENST ID: ENST00000552613
  CDS Start-End: 254-415
ccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggca

SEQ ID NO: 184654 - DNA, 2493 bp, Homo sapiens
  Payload ID: 16360
  Gene Symbol: SLC8B1
  Gene Name: solute carrier family 8 (sodium/lithium/calcium exchanger), member B1
  ENST ID: ENST00000550047
  CDS Start-End: 1198-1497
tgtttagtgcttaatgattttttaaaattttagtttttacttttggaaactcaatgaatgtaccaaccgaagggtgttgaattttcagcaaatggatcatttagggaagttgccttttactacttagggaaaattgtctttcactgttttttcaagtaccgacgtgtgccacaacatggatcacccttgaaaacatgatgctgagtgagagaagactgtagcagaggatcacacactgtggcattccattgatgtgaaatgtccacgaggcacattcagagagacagagagcagagtagtggtcgagttgggctggtggggtggggctagggagtgaccgctaatgagtacagggatacttattgggatgatgggtggtatttggttcatagactggaaatctgatgaaagtgataaggaaccctttccagacaaaataatatttttttttagtatatgaaagggaggtttttttgtttttattttttttcttttttcgagacagagtctcactcagtcgcccaggctagagtacactggcatgatctaggctcactgcaacttctgcctcccgggttcaagcgattctcccacctcagcctctcgagtagctgggattacaggtgtgtgacaccagcctgactaatttttgtatttttagtagagacaaggtttcaccatgttggccaagttggtctcgaactcctgacctcaggtgatctgcccgcctcggcctcccaaagtgctgcgattacaggcggtgagccaccgtgcccggcctgaaagggagtttattaaggaaaaaagaaaataatattgaactcacgttttattgagcactaactttgcacaggcaccaatgcatatagtaacgtgttttatactcataataagctcatgaggtagatactgttatcatcccgtttcacaggtgaggaactgaggctgtgttcctgttggggctggccttggtcccacagcaaaccattccctccgcagctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtc

SEQ ID NO: 184655 - DNA, 555 bp, Homo sapiens
  Payload ID: 16360
  Gene Symbol: SLC8B1
  Gene Name: solute carrier family 8 (sodium/lithium/calcium exchanger), member B1
  ENST ID: ENST00000549372
  CDS Start-End: 247-555
aagacaagggaggagcagagccctagcaggatactaaatgggtctatgtgactttagggaccctctgcttttggactagcctggaacccaggttcagtcctgctgacctggcactggaagggaggcagggtgctggcacccacgagcaagccacagccaagcaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctac

SEQ ID NO: 184656 - DNA, 925 bp, Homo sapiens
  Payload ID: 16360
  Gene Symbol: SLC8B1
  Gene Name: solute carrier family 8 (sodium/lithium/calcium exchanger), member B1
  ENST ID: ENST00000549181
  CDS Start-End: 232-925
agagtaggggcccggacgctgcagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgg

SEQ ID NO: 184657 - DNA, 850 bp, Homo sapiens
  Payload ID: 16360
  Gene Symbol: SLC8B1
  Gene Name: solute carrier family 8 (sodium/lithium/calcium exchanger), member B1
  ENST ID: ENST00000549605
  CDS Start-End: 213-374
tgcagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcagtgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttcc

SEQ ID NO: 184658 - DNA, 2925 bp, Homo sapiens
  Payload ID: 16360
  Gene Symbol: SLC8B1
  Gene Name: solute carrier family 8 (sodium/lithium/calcium exchanger), member B1
  ENST ID: ENST00000550672
  CDS Start-End: 1-1214
ccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagacgaggaggatgcaggtggctgggaagacgaaacgccacggtgcctagaaacagcccacacggtacctcatgtcttcactgcgtgttggatatacctgctaagtgtggaaggaagagaagcggggaggggacatttcagtcccttttactcttctgtactgcttgaaaatatgtcagcaaccatgtgtgacatgtataccatagatagtgttagttccctagtgctgccataactgaccacaaaccagggggctgacaacagcagaaattgagtctctcccagttctggaagccaaaagcctgcaatcagggcatcagccgggcagtgccacctccaagctccagaggaggatccttcctcacctcttccagctgctgttggctcctgacgttccttgcccagtgggcccatctctgcagtctctgcctctgtgttcccatggccatctctctcttcttcttacggagacatgagtcattggatttaggggccaccctaagtccaagatgattgtatcttgaaacccttagcttattatatttgcaaagaccctatttcagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaagtcaaaa

SEQ ID NO: 184659 - DNA, 996 bp, Homo sapiens
  Payload ID: 16360
  Gene Symbol: SLC8B1
  Gene Name: solute carrier family 8 (sodium/lithium/calcium exchanger), member B1
  ENST ID: ENST00000548186
  CDS Start-End: 603-996
agcaggcggggcacccggactggcggcttcgctggcgcaaggtcggtccggcggccagggacctggaaggctgcgaggccctgcgaggtcgaggttcggagtttgctggtcccaggcccggcccgaggtcggcgaccatccgagcgctgggcatcggcccacgcgtacagaaggcgctcaataaatgctcactagtgaatcagtaaaataaatcggcagcaaagagagacgagacgcatgctgatcttcaggtgttggggacatcagggacgcgaacatttattgagctcttattgtataccgcgtcggccagcatttgtgtccatttcacacatgaggaataagaggcccagagaggtgaagtgacttccttaaggccacacagatagtaagtggccgagacgaatttgaaaccaggggtgtcctgtttgaacttggtgccaaatagagtaactcggactccagttggaggggttcgggagaaccatagaagaggaagggccgtgtcttccgtggacaggccaccggagccgccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctacca

SEQ ID NO: 184660 - DNA, 1058 bp, Homo sapiens
  Payload ID: 16360
  Gene Symbol: SLC8B1
  Gene Name: solute carrier family 8 (sodium/lithium/calcium exchanger), member B1
  ENST ID: ENST00000549069
  CDS Start-End: 182-613
gccactgtgcccagctggtagccgcgtttttcacacctgcaaagttgttcctggtgtgaaagagtggggtaaaggaattaaggagggaagtgtgtcttcccagatgctgtgccccctcacacagcaccccaccagctagtgcccaggcacacttgggcatccatctgtgtttgttgcctgaatgaccgtgggtgagaatgaaggcgtggatgaccagggagggtgggggaagcgactcaccactgcaggcccctcttgttcctgtgcagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactc

SEQ ID NO: 184661 - DNA, 1656 bp, Homo sapiens
  Payload ID: 16360
  Gene Symbol: SLC8B1
  Gene Name: solute carrier family 8 (sodium/lithium/calcium exchanger), member B1
  Uniprot ID: Q6J4K2
  ENST ID: ENST00000546737
  CDS Start-End: 70-1656
ccagctgtttggaactgagctactgcagaaagggaagtggagagtaagggccaggccccgtgggggcagatggccggcagaaggctgaatctgcgctgggcactgagtgtgctttgtgtgctgctaatggcggagacagtgtctgggactaggggctcgtctacaggagctcacattagcccccagtttccagcttcaggtgtgaaccagacccccgtggtagactgccgcaaggtgtgtggcctgaatgtctctgaccgctgtgacttcatccggaccaaccctgactgccacagtgatggggggtacctggactacctggaaggcatcttctgccacttccctcccagcctcctccctctggctgtcactctctacgtttcctggctgctctacctgtttctgattctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtga

SEQ ID NO: 184662 - DNA, 4428 bp, Homo sapiens
  Payload ID: 16361
  Gene Symbol: SLC9C2
  Gene Name: solute carrier family 9, member C2 (putative)
  Uniprot ID: Q5TAH2
  ENST ID: ENST00000367714
  CDS Start-End: 424-3798
aaatggattttggtgtgatatcagttggtagtactgtccctggcaaacagacgcataactgtgcattgttctttgggattttgagagccttcatctcaatttcaactttaaagcagcttaatctttaaggaacatatctctgatctgggtaatttgtagaacttaatttgagggtcattacatgtgaggatagcaggagttgaagatgccaaggacctgaagggctactggagggacaggtgaagtgatttgaagatgtagcattttgaatctctttctggcccatcctctgcttcacaccagaatcattgtgacctgtagacctgcaaaacaaaggaccaaaggttagcatgcagaagtgaaagtgtcaataataaccaaaccactccatcaagttaggtctggggaaaagcagcagcaaaaatgagttcttacttctgggcacaaaatgaaagtaacagacctgatttactctgcgggcagccagctgactaccttgttgaagagaaacatttcacaacgcttgtatgcttcattgttgttttgggagggcttttgaagatgtgtttaaagaattgtgaagtcattgttttgacgattctttctctatcaggattcgtgataggacacatggcctacaattctgttgaggtgcaccaaattgtctaccctcttctaagaacatcaagtttttcactttattcttacttttcacctttaattatatttatggttgctttggatgtagaattttatacactcaagaaaatgttttggcaggtcttgttaactggattaattagcttttctacagcaagcatcataattggatatgtcgttataaaattcaataaagattcatgggatttgcaatcttgcctactctttagcatcacccttggcattatagatcctcttcgttctgtgaattcactaaaaactattggcatttctaaaatatacattgatctcattagaggagaatcattgatcatttgtagcatcgcatcaattttttttggaaattttcggggcaacagaatccacttttctatttttagagatttacatgtaggcattgaactcagctatgacattttgggaagcataatatttggatattggtgtgcaaaaatcattcagtgtatattggctgacgtttttagcaatatgctgactaatatcattctctgcttttcaatggtgtacatgactttctatattgtggaatttttaggaatgtcaggcactcttgccttagccgctgtaggactgaatttagattctttaacttttaaaccgaagatcgaacttgtaattactaagttcttaagaattttttcatctgtatatgaacatttaatatatgctttctttggcattgtgattggatgtggagaactcagccactatgaatttcacactatacctttcatattcattttatttacaacagtgaatttggtaaggttgcttactattttgttagtgagccctattttgatgcattcaaattatgaatataattggcgatggggagttgtaatcacgtggtctggaattaaaggagtttttaatttactctgggctcctgatgtttataatctcgctgaacgaaaagtggaagtaccacaaatgtttatactctatgtacaagtaatatcattattgacaatgggaataaattcatacgtgatgactcagtcagccaggaagttagatttgtgtgttctttccctcccaagacaaatgatcttgcaaaatgccactcagcacatacaggagatagtacagaacacaataactttatttaaaacagaaaaaattttgacaaatgttaactggaccttagtagaagataaaacgaggatcgaatacattcctttttcccacgtttcacataatgatatgaagacagaatccacaacagatgaagctttaatggaggaagccagattgcatgtagctgcaatacaaatgagtagctttgaaaaacagcgtaacaatggaattcttgaaatagaggcagcccggatattaattggtgcagcaaaatgctattactccatccaaggaaaattcatgagtatttatgatgtttcaacttatatgagaactagaagttggcttataaagtttaaaaatgttttaactttcttggaatattgtatagaaaagatacattttattccacctgagagtaatacatttctgacttttatatttcacatagtattttctgaagaatttgaatatacaggacagattataaatttgatatatatttatcctatgataatacatctgtggccaatggcaagaggtttaaatgtatcagcactgatatcaataaactactattttatgtttttatatgtattagaatcaacattgaagataataattttgaaaaggaaatattttcaacaatgttggaatactttggaattttttatcctggttattggaatcattgatatcttttgtgtatactttgtgaaattgagaccagacaacttggctcttatacagcttacagtaataatgggatatttaagaataattaggtttcttcctctcttcaagataatagtaccaatactgataagaattgcagatgtgcagatcaaaaagcgcctcagcttgatgtatagtattacaaaaggctatatcaaaagtcaagaagatgccaaacttctaataaaacaaatagctgtctgtgaatcaatatatcagaaactatgtgaaattttggaaaccaacaaacaggatgctgtcaaagaattagtactcatggagcatgagggtcgtgatgttgtcattgctttgaagactaaacaggcaatccggaatgtgattgctaaagctctaaaaaatctcaccttcctttgttcaagaggcattattgataagcatgaagtcattgagataaataaggtacttcttaaaaaattaaaagcactaaataactttccaaaggcaatcccacccccaactcctgacatataccttcacaacatcatttggctggaaggtaaagatgttctcattgacttcttcaaggaaagagccaaacttgcctgttttgactctggagataccatttgtaaaggaggtgaaatgccacaaggaatctacttaattatttcaggaatggcaattttgcatagtttatctcctacctttggaatagagagtaatcaaaggtgtgatagagggtccagagacatgtttacagagttctgtactactggggacataattggagagctaagctgtctgcttaagcgtgaaattgaatataccgtcatctgtgaaactagtttacaggcctgctttatctccctggaggatttatatgaaggctttgatgccttctggccatctctggaatataaaatatggctaaagcttgctctcagtactgcctatcagtattttgaatcaagtcttattgatgaggacttaaggtttcagaactgtgtgatgttcaatcaagcatatgtggaaactttatcaagctatagtgacatgattattgataatatgaccatgaaatttgttatcattgtgtatggcagtgtaattgatactaagacagaggaaccatattttgcaccttgcattatacctacaacctgtgagcaggttcagggaacttctgatttaagcaagctgctgataatccaagcatctgagcttacccaaagaaatagtaacaccaatgtcatggcctcagtcaacacggtctttgaacaaccaggaaagaatataaatggaagacaaaagatgagttgaaaactggataccattttagaaaagggtattaatgatacaaatatgatgtgtggagtcaggttaaagaccaaactactttcctcgctcaaatactaaaggattatctgcaaggagtttacttagaagctactgaaacaggttactgctgcatttagtttataagcaatggatggacttctgtaaaacttcttaattttaagtagttgcattatatttgggatgttaaaaaagtcttcaggataatataaaatacactgaaacatatgtcctaccaaatgaaaccctgtttccagctaagagcaaattttaacatagtgcattataaaaagtgttgtataactgatatgttactctctaaagcatagaacctgtaattttcatttgtgaaattgttataattagtgcctccctaatattttcccgagtatagctattctccccttcccagtttggtaaatattgaaaaacagaattatattccacaatcttagtaactttcagtaagtaagtaacttttgctttcagtgaaatttaggagaaattaatattctcatattgcatagtactgtttgatgtcacctttcattttatttttaaaaatcaaataaagttgagttttatggttgtcta

SEQ ID NO: 184663 - DNA, 4516 bp, Homo sapiens
  Payload ID: 16362
  Gene Symbol: SLC9A1
  Gene Name: solute carrier family 9, subfamily A (NHE1, cation proton antiporter 1), member 1
  Uniprot ID: P19634
  ENST ID: ENST00000263980
  CDS Start-End: 577-3024
cggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacaccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 184664 - DNA, 695 bp, Homo sapiens
  Payload ID: 16362
  Gene Symbol: SLC9A1
  Gene Name: solute carrier family 9, subfamily A (NHE1, cation proton antiporter 1), member 1
  ENST ID: ENST00000374084
  CDS Start-End: 290-695
atctgacttaggcttttaaagggatccttctggctgctttgttgaaacaataatctgggtggggaaaatggcactgcttggaccagagtgggcaatggaggtggtcagaaatggatggattctggaaatattttgaagattgaattgacactatttgtggaggattgatatgacagaaaggagccaaggatgactcaagtttttggccagagattattcgaaagcccttatgagactgcagatgtggacgtgaaatcgttttgtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctga

SEQ ID NO: 184665 - DNA, 2183 bp, Homo sapiens
  Payload ID: 16362
  Gene Symbol: SLC9A1
  Gene Name: solute carrier family 9, subfamily A (NHE1, cation proton antiporter 1), member 1
  Uniprot ID: P19634
  ENST ID: ENST00000374086
  CDS Start-End: 265-1932
caggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcaggtgctgggccagggcagggcaggcccttgccttggggaccctcacaggctgttcccgtggaaagagaggaaagcgtgtgatttgaaatgcgattctagtcccagctccaccactaacttgctgtgtgaccttgggcgagccactccccctttctgggcctcagtttcttcaatcgtaaagtgagaattgtgatgagtcattgcagagtgactgatcagaatgtaaaggaaccagaatgctgcccaacttaatttggaactcatagagcattaagagaagtgggtactggccgggcacggtgactcaacgcctgtaatcccagcactttgggaggctgagggggtggatcacctgaggtcaggagtttgagaccagcctgactaacatggtgaaaccccgtctctactaaaaatacaaaattagtgggcatggtg

SEQ ID NO: 184666 - DNA, 5410 bp, Homo sapiens
  Payload ID: 16363
  Gene Symbol: SLC9A2
  Gene Name: solute carrier family 9, subfamily A (NHE2, cation proton antiporter 2), member 2
  Uniprot ID: Q9UBY0
  ENST ID: ENST00000233969
  CDS Start-End: 143-2581
ccggtgccgcagcagcggcgggtggctgtcgctgccctgccctgcacggggcagggcggagcgggctgagcagcccgggcgcgatgcgttgagcgctcggagggccaaccgccggtccccttggcggcaaccggcggcacccatggaaccactgggcaactggaggagcctgcgggcgccactgcctccgatgctgttgctgctgctcctgcaggtggcggggcccgtgggcgccctggcggagaccttgctgaacgcgccgagggccatgggcaccagttccagcccgcctagccctgcgagcgtggtggctcccggaacgacgctgttcgaggagagccggctgcctgtgtttacgctggattacccccacgtgcagatccccttcgagatcaccctttggatcctgctggcctccctggccaagattggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaagaaaaggaaaatcgaataaaaaatagtcccacaaaataccttttgtgactaatgggtagcaatcgtattatttgctggcctgaagagaaaaaatggtaatgtgtgcctttattgaacttgaatgacagaacttgaaatttttaacacatccttcttggtgaagattttaatatattacttatatgcttcaaattttatttatgaaaaaatatgtatatctgtaatcagttgttaagtgaatggcactaaaagtatcgagaacagctttctttcccaggggtgaaggatggcgctcgggggtgactcctaagctcagcgtggaagcttttccctgtcctgacccgatggagcagccggtaagtgaagagcacagctggaagcagagacaccttatgactcaaactgggcaaacaatcggaacgtcatgcagaaggaatggcctgactcctgcagtgcagattggaggccccagaactcctatgaactactgagagtctactggtttttaacttgttcctctgtctactgtgtgtttgggggtgacatctaaattccatttcttcttcttgtttaaatggtgcagagagaaaggttgcccagacatccaccagcttactgtgttgacagatttgggagcagcttttgatgaagttccacccatgagggtccatgtggcaagtagggccacagggcagcacctggttacaacttgctggtgggttttatgttgtgcaatactaggaggaggaggcaggtgatctatgctgatctatgatcacctgcttcagtagaatttttctgtagagtgttgtttgaattttgagcctccaggttagaggctccaagcagacaaagaagaaagtttgtagacacaatattctaacattgcacaagttgatgagatatcaagttttgaatattattcaggaagcactttggagaatgtgggagtcctactgttttgcactagtctgtaatttgttacctctccccattcgataatatagtaactcagaattttcatataaaattgaattctactcattagagtactttttaaaagtacagcagaaagaaaagaagtggaacataagcattcaagattaatatttgattctctatctcttaactgtagattttattggcctgttttttttttctaaataattctttaaaacttgactggaacatgcctctgcatttctgagtgtagaaattaaatgaagccactcacagtcctttgatttcccactgaagataccccaaaggatgcaagtgcctacagtattatcaggaggagaacatgaaaatattaagacaaaaatcctcagcagttgttctccaccccttctccacctccaccagcaaggagaagtcaatctacacttttttctcatgttctaaagtcttagaatactgctggattgttgagcatgagacagagcaaaggttagatacacaaggtacaagttcataggagcacaattccttgattcagggaaagtagcacagaatgcaatttgaaaactacaggcttaggactctgtgccaaaaatctctattttaaatgaaaatatttatataaaaatacatttattctgcttaacacaaattaaaactgacataaaattttatgataataacatgattcaagaaatgtgatgtagatttttgagaatgccaaaaatcaggtttcagaaaagctacagtatgaaatctgaaaagcaacagaaattgaaagtgaccttaaagaataaatttcctaatttttcccagtttcctatgtttataactattataaagagtttaactttctggaactgaaggagaaaacatgaaaatgtttatattgcttcttgttaagcaggtagaccaaattccgctttcagtaattcatccatacagaatttggatgactatgtataaaggaaaacttaaatcttaattattatcagtttaaattttttttgtttgttgaatgacaaaggcaataaaaataaatttgactttagctttttttctatactttcctctttttgtaattcttaaattctagtcactagtcattatgagagtattgactaaatattttcacaatctaaatattgtcacaatctaaatttctgtagtagagagagccgtagccctttgtaaaggctttcgttcgtccaaacaacacttgatccaaccaaagttccaatgtgactgtggatctttgataggtctttggtgttggttgtaacaaaatttgatttgaactacctataaatgaaaagtcggggtttattactttatatgtaatgctgagaggagactgttgggaacagttatgtcaatgagcaaactagaaattggcttcaaagtctaatacttttaaaagcatgtgttttgtgtatatgctcacaaaatgtctgtgaagagatttctttcagcttttgctcagctttatggtggggtgtactgttttatctgggcggtgagggtattgatttacataaaaactgtagacaaacacagtacgagtctcagcacgttttgcatttattgtactgcccaaattgtttttatgttaaaagtcacgtttcataatctgcaatatttttgtcaaagtgcacactgtactttcttcttaaaaacgtgattaaagagatcactttgtccggatgaa

SEQ ID NO: 184667 - DNA, 2584 bp, Homo sapiens
  Payload ID: 16364
  Gene Symbol: SLC9A3
  Gene Name: solute carrier family 9, subfamily A (NHE3, cation proton antiporter 3), member 3
  Uniprot ID: P48764
  ENST ID: ENST00000264938
  CDS Start-End: 11-2515
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcggccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttctgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 184668 - DNA, 2504 bp, Homo sapiens
  Payload ID: 16364
  Gene Symbol: SLC9A3
  Gene Name: solute carrier family 9, subfamily A (NHE3, cation proton antiporter 3), member 3
  Uniprot ID: P48764
  ENST ID: ENST00000514375
  CDS Start-End: 9-2486
aggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcggccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttctgccgcctgatgcccttccgcctcagcagcaagtccgtggactccttcctgcaggcagacggccccgaggagcggccccccgccgccctccccgagtccacacacatgtgacaccggctccgacacgcc

SEQ ID NO: 184669 - DNA, 219 bp, Homo sapiens
  Payload ID: 16364
  Gene Symbol: SLC9A3
  Gene Name: solute carrier family 9, subfamily A (NHE3, cation proton antiporter 3), member 3
  ENST ID: ENST00000626862
  CDS Start-End: 9-219
aggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcg

SEQ ID NO: 184670 - DNA, 221 bp, Homo sapiens
  Payload ID: 16364
  Gene Symbol: SLC9A3
  Gene Name: solute carrier family 9, subfamily A (NHE3, cation proton antiporter 3), member 3
  ENST ID: ENST00000628307
  CDS Start-End: 11-221
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcg

SEQ ID NO: 184671 - DNA, 1969 bp, Homo sapiens
  Payload ID: 16365
  Gene Symbol: SLC9A3R1
  Gene Name: solute carrier family 9, subfamily A (NHE3, cation proton antiporter 3), member 3 regulator 1
  Uniprot ID: O14745
  ENST ID: ENST00000262613
  CDS Start-End: 196-1272
gtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaa

SEQ ID NO: 184672 - DNA, 519 bp, Homo sapiens
  Payload ID: 16365
  Gene Symbol: SLC9A3R1
  Gene Name: solute carrier family 9, subfamily A (NHE3, cation proton antiporter 3), member 3 regulator 1
  ENST ID: ENST00000581356
  CDS Start-End: 1-107
gcggggacgagaccaagctgctggtggtggacagggaaactgacgagttcttcaagaaatgcagagtgatcccatctcaggagcacctgaatggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgt

SEQ ID NO: 184673 - DNA, 841 bp, Homo sapiens
  Payload ID: 16365
  Gene Symbol: SLC9A3R1
  Gene Name: solute carrier family 9, subfamily A (NHE3, cation proton antiporter 3), member 3 regulator 1
  ENST ID: ENST00000583369
  CDS Start-End: 196-841
gtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggccc

SEQ ID NO: 184674 - DNA, 1285 bp, Homo sapiens
  Payload ID: 16365
  Gene Symbol: SLC9A3R1
  Gene Name: solute carrier family 9, subfamily A (NHE3, cation proton antiporter 3), member 3 regulator 1
  Uniprot ID: O14745
  ENST ID: ENST00000413388
  CDS Start-End: 37-645
tccctgcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctg

SEQ ID NO: 184675 - DNA, 1564 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENST ID: ENST00000432365
  CDS Start-End: 79-1059
gccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttc

SEQ ID NO: 184676 - DNA, 2194 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENST ID: ENST00000424542
  CDS Start-End: 139-1152
ggagcccgagccggatcccgaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttcctccccgccccctcccctcagcagcggccgtcctgagtgggagtccctgggacttcccagtggccaagttggggcgcccagcctcttcgtggggaccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcaggataaacaggccctgcctggga

SEQ ID NO: 184677 - DNA, 578 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  ENST ID: ENST00000567504
  CDS Start-End: 126-578
agagagatggaagcggccggccgggcgggagcctgaagcagccttacccaggaattgcaggggttggggtggcgagcagtcgcggcgcctcagcctaagtggcttttaggggcagctgccgggatatgggcacccagggggccatggcccaggaggctgcccagaggcgagccctgtgcttgggtgggggcaggggagcccagcccagggccccggagagacgagagggagaggaggactgcgccaagcctgcttctacggctcacatggggaattgcctgggctggctgtgcctgacccctgggaaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggc

SEQ ID NO: 184678 - DNA, 759 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  ENST ID: ENST00000565855
  CDS Start-End: 89-759
agataagtggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaactt

SEQ ID NO: 184679 - DNA, 1037 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  ENST ID: ENST00000563587
  CDS Start-End: 161-856
atgtgctgcccggaatgtgggccactgacccgctcctatcgcccattcgccccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtgg

SEQ ID NO: 184680 - DNA, 1199 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENST ID: ENST00000566198
  CDS Start-End: 82-762
tggggtggcagcctgggtcggccagagagttcaggccaccccggccggacgcctgccacttgctgtcactgtgccgctgtcatggcacgctccgggagtgccacgccacctgcccgggctccgggagcccctccacggagcccaccccagaggctggtacaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctccccc

SEQ ID NO: 184681 - DNA, 738 bp, Homo sapiens
  Payload ID: 16366
  Gene Symbol: SLC9A3R2
  Gene Name: solute carrier family 9, subfamily A (NHE3, cation proton antiporter 3), member 3 regulator 2
  ENST ID: ENST00000561844
  CDS Start-End: 1-500
gcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggaggggccaccgtctggggtgtgggactagggctcactccagacaccccacccaccgtgctcaccccaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccg

SEQ ID NO: 184682 - DNA, 4138 bp, Homo sapiens
  Payload ID: 16367
  Gene Symbol: SLC9A4
  Gene Name: solute carrier family 9, subfamily A (NHE4, cation proton antiporter 4), member 4
  Uniprot ID: Q6AI14
  ENST ID: ENST00000295269
  CDS Start-End: 458-2854
agacagggaaggtttcctttcctcattagaaggactccagtgatctgtggaatgagcactacagtatccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtctattgaataactgcatttgagttggaagctgagttgcctgaacacaaacgatttaaaccagattagaaagtgtctacatacagagctcaataacacactcggaatcttcttgggaggacccacagactgtacctatattacttttgacccaggtggatgcagtcactctctagaagcctccccgacttcagatgtgtggcacacatccacacaggggtgtaggtaggagaagcccacaggaatggctctgcagatgttcgtgacttacagtccttggaattgtttgctactgctagtggctcttgagtgttctgaagcatcttctgatttgaatgaatctgcaaattccactgctcagtatgcatctaacgcttggtttgctgctgccagctcagagccagaggaagggatatctgtttttgaactggattatgactatgtgcaaattccttatgaggtcactctctggatacttctagcatcccttgcaaaaataggcttccacctctaccacaggctgccaggcctcatgccagaaagctgcctcctcatcctggtgggggcgctggtgggcggcatcatcttcggcaccgaccacaaatcgcctccggtcatggactccagcatctacttcctgtatctcctgccacccatcgttctggagggcggctacttcatgcccacccggcccttctttgagaacatcggctccatcctgtggtgggcagtattgggggccctgatcaacgccttgggcattggcctctccctctacctcatctgccaggtgaaggcctttggcctgggcgacgtcaacctgctgcagaacctgctgttcggcagcctgatctccgccgtggacccagtggccgtgctagccgtgtttgaggaagcgcgcgtgaacgagcagctctacatgatgatctttggggaggccctgctcaatgatggcattactgtggtcttatacaatatgttaattgcctttacaaagatgcataaatttgaagacatagaaactgtcgacattttggctggatgtgcccgattcatcgttgtggggcttggaggggtattgtttggcatcgtttttggatttatttctgcatttatcacacgtttcactcagaatatctctgcaattgagccactcatcgtcttcatgttcagctatttgtcttacttagctgctgaaaccctctatctctccggcatcctggcaatcacagcctgcgcagtaacaatgaaaaagtacgtggaagaaaacgtgtcccagacatcatacacgaccatcaagtacttcatgaagatgctgagcagcgtcagcgagaccttgatcttcatcttcatgggtgtgtccactgtgggcaagaatcacgagtggaactgggccttcatctgcttcaccctggccttctgccaaatctggagagccatcagcgtatttgctctcttctatatcagtaaccagtttcggactttccccttctccatcaaggaccagtgcatcattttctacagtggtgttcgaggagctggaagtttttcacttgcatttttgcttcctctgtctctttttcctaggaagaaaatgtttgtcactgctactctagtagttatatactttactgtatttattcagggaatcacagttggccctctggtcaggtacctggatgttaaaaaaaccaataaaaaagaatccatcaatgaagagcttcatattcgtctgatggatcacttaaaggctggaatcgaagatgtgtgtgggcactggagtcactaccaagtgagagacaagtttaagaagtttgatcatagatacttacggaaaatcctcatcagaaagaacctacccaaatcaagcattgtttctttgtacaagaagctggaaatgaagcaagccatcgagatggtggagactgggatactgagctctacagctttctccataccccatcaggcccagaggatacaaggaatcaaaagactttcccctgaagatgtggagtccataagggacattctgacatccaacatgtaccaagttcggcaaaggaccctgtcctacaacaaatacaacctcaaaccccaaacaagtgagaagcaggctaaagagattctgatccgccgccagaacaccttaagggagagcatgaggaaaggtcacagcctgccctggggaaagccggctggcaccaagaatatccgctacctctcctacccctacgggaatcctcagtctgcaggaagagacacaagggctgctgggttctcagatgatgacagcagtgatccaggatccccatccatcacgttcagcgcatgctctcggatagggtcacttcagaagcaagaggcacaagaaataataccaatgaagagcctacacagaggaaggaaggcattcagctttggttatcaaagaaacacaagccaagaagagtacttgggtggagtaaggagggtggccttaagacccaaacctctgtttcatgcagtggatgaggagggtgagtctggaggggagagtgagggcaaggcctctttggttgaggttcggtcgaggtggacagctgaccatggacacggcagggaccatcacaggtcccatagtcctttgctccaaaaaaaatagtgttattgtccacaagattgttttggtgtttctcaagagtctgtcttcctataactgtgaaaggaggatttctggaattcagaagagagctattgagtttgctgtgttgaagctattaaacatggatctataagcagcaggaagattttttccaaggactgggagcaaacttgcaggctctgccatgtacttattgtggggtacctttagatgaattccctgtgagtgagagaagttgatcaccccaggaattagtcactaagaattcctaagaactttctatcaaaagcattggatccaagccatatattgaaatacaagcgtgattaatcagtaattcacattgccgatatgcatatgcaacttataatcaaatagaactagaagagactttgaagtcacctgactcagccccttgtgtttacagacaaggacatgtagtccaaggttgcatggtgagttcacagtcggattgtcctccctccaaactgaaactaatttgattttgatttcatattcaatatgcaataattatgttctatcagagataaaatttgttatgaatttgctttatttaatcagtagcaatgatagatgtgatgcatactataggattaatctgtgaacaatgggtttacggtctatttcataattgaaatatttattttaaaaatgaatattagaaacaaaacagccataaacagagtttaatagcaatgatgttaacaacaagtatttataaggggtgcatttgtagggtgtgacattttaccctagggtataaaactatttttcttttattattattattattattattatactttaagttttagggtacatgtgcacattgtgcaggttagttacatatgtatacatgtgccatgctggtgtgctgcacccgctaactcgtcatctagcattaggtgtatctcccaatgctatccctcccccctccccccaccccacaacagtccccagagtgtgatgttccccttcctgtgtccatgtgatctcattgttcaattcccacctatgagtgagaatatgcggtgtttggttttttgttcttgggatagtttactgagaatgatgatttccaatttcatccatgtccctacaaaggacatgaactcatcattttttatggctgcatggtattccatggtgtatatgtgccacattttcttaatccagtctatcattgttggacatttgggttggttccaagtctttgctattgtgaataatgccgcaataaacatacgtgtgcatgtgtcttta

SEQ ID NO: 184683 - DNA, 3736 bp, Homo sapiens
  Payload ID: 16368
  Gene Symbol: SLC9A5
  Gene Name: solute carrier family 9, subfamily A (NHE5, cation proton antiporter 5), member 5
  Uniprot ID: Q14940
  ENST ID: ENST00000299798
  CDS Start-End: 66-2756
gtggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgg

SEQ ID NO: 184684 - DNA, 3472 bp, Homo sapiens
  Payload ID: 16368
  Gene Symbol: SLC9A5
  Gene Name: solute carrier family 9, subfamily A (NHE5, cation proton antiporter 5), member 5
  ENST ID: ENST00000564812
  CDS Start-End: 144-671
ggacctggcttgggggtatcggagccgggattggggggagcgggccccacgtgcctgtgacgcgggggcgcccggtaggtggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacgtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactg

SEQ ID NO: 184685 - DNA, 819 bp, Homo sapiens
  Payload ID: 16368
  Gene Symbol: SLC9A5
  Gene Name: solute carrier family 9, subfamily A (NHE5, cation proton antiporter 5), member 5
  ENST ID: ENST00000566626
  CDS Start-End: 1-819
ctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtgtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggg

SEQ ID NO: 184686 - DNA, 920 bp, Homo sapiens
  Payload ID: 16368
  Gene Symbol: SLC9A5
  Gene Name: solute carrier family 9, subfamily A (NHE5, cation proton antiporter 5), member 5
  ENST ID: ENST00000566345
  CDS Start-End: 406-920
aagccaccctggcagaccgacggcgagtggaactcgagcacctccccaggtgcgcctaattcgaagggcagtcagaatggcggagccaagttcctggcacccctcttcagtttcccctcaacttgagaggggactcccccgcaggcggggcagagtggaccctgggaccccagcccaagacttttccggagaagaacactcgctccagcctcttcccgcggagcacctcccaccagttttcatggcgcccaccctgaacccccgatcgccccaacctttctccggcctccctcaccttgagcggcgctcccagcaggcggtgcaccgcgggtatctgcgcgcccaagggcagcgccccgtccaggctgcaggtgggggcccggcgcggctccggaaagttggcacatgcgaaggggtcggtgtcttccagtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccg

SEQ ID NO: 184687 - DNA, 535 bp, Homo sapiens
  Payload ID: 16368
  Gene Symbol: SLC9A5
  Gene Name: solute carrier family 9, subfamily A (NHE5, cation proton antiporter 5), member 5
  ENST ID: ENST00000567247
  CDS Start-End: 1-535
ttctttgacaacttgggtgccatcctcacctatgccgtggtaggcacactctggaatgccttcacaacaggcgctgccctctggggcttgcagcaggctggacttgtaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaaggatggtgtggcgaatgctgaggctacaaatgggaaacatcgaggcctgggctttcaggacacag

SEQ ID NO: 184688 - DNA, 4711 bp, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENST ID: ENST00000370695
  CDS Start-End: 69-2174
gagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaaca

SEQ ID NO: 184689 - DNA, 4631 bp, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENST ID: ENST00000370698
  CDS Start-End: 77-2086
tttcccgtgagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaa

SEQ ID NO: 184690 - DNA, 4466 bp, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENST ID: ENST00000370701
  CDS Start-End: 111-2060
ccctttcccgtgagccctcggggagtggtccgaccgcgggcggccgccggtgagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataacca

SEQ ID NO: 184691 - DNA, 648 bp, Homo sapiens
  Payload ID: 16369
  Gene Symbol: SLC9A6
  Gene Name: solute carrier family 9, subfamily A (NHE6, cation proton antiporter 6), member 6
  ENST ID: ENST00000627534
  CDS Start-End: 97-648
gtgagccctcggggagtggtccgaccgcgggcggccgccgtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctg

SEQ ID NO: 184692 - DNA, 619 bp, Homo sapiens
  Payload ID: 16369
  Gene Symbol: SLC9A6
  Gene Name: solute carrier family 9, subfamily A (NHE6, cation proton antiporter 6), member 6
  ENST ID: ENST00000630721
  CDS Start-End: 1-619
cttatgcacggcaaatgatgttcagcaccacgcttctgattgtgttttttaccgtgtgggtatttggtggtggcaccactgcaatgctgtcatgcttgcatatcaggtactgtgctagactctggggatacagagatgaattgagacatggcctttaccctcaaggaactcacagtctttttggggagactgacagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggt

SEQ ID NO: 184693 - DNA, 3838 bp, Homo sapiens
  Payload ID: 16370
  Gene Symbol: SLC9A7
  Gene Name: solute carrier family 9, subfamily A (NHE7, cation proton antiporter 7), member 7
  Uniprot ID: Q96T83
  ENST ID: ENST00000328306
  CDS Start-End: 27-2204
gaggaggcgcggggggccccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaaaggcaaatagtgttatactcttattttttgattaatctgaggaaaggaggtatttagaaactgatgatggtatcactgcaaaaagcattcaactttttttttttgttgagatggtgtttcactctgtcacccaggctggagtgcagtggcgtggtcttggctcactgcaacctctgcctcacgggttcaagtgattctcctgcctcagcctcctgattagctgggattacaggtgcccaccaccatgcccagctaattttttgtatttttggtagagatggggtttcaccatgttgcccaggctggtgtcaaactcctgacctcgtgatccacctcccttggcctcccaaagtgctgggattacaggtgtgagccactgcacctggccagcattcaacttttgagggctaccatatgagctgacagcctagggaaataatcactaggactgaagtatctactctgggtttagaaataacaccaaattttgtaggatgctattatctgggaaagggaaggcagcaagaaacctacaaggcaccaggctagaattcagagggaaagaaatctcaatgcaaaaaaattactgcaaagaaatacaagatagtagtctcaagactaggtagaattccaaactttgagccgacgaatgcatgagatttcagtggccacctgaggaatcagagggcaaacaatggaacattaagtattttcagcccactagaaagctctgtcttctataagcttaagagtccgagtgtctttacaccactgagtgccatgcagagaagggtcattttccttgtatctggggaggctgctgcaccagcttaacatgtgggtgtgatttgaaagttaggttttcagtttggattctttctggatgagctgttctgtctgcccacacctgtagtgctgaaatacagaaagacctctcgggaaaa

SEQ ID NO: 184694 - DNA, 10024 bp, Homo sapiens
  Payload ID: 16370
  Gene Symbol: SLC9A7
  Gene Name: solute carrier family 9, subfamily A (NHE7, cation proton antiporter 7), member 7
  ENST ID: ENST00000616978
  CDS Start-End: 144-2324
gggcgcagccccggcccggcgcgagtaggaggaggagctgcagcggccacggccactccggcaggtccgcggtgctgccagaacccgccgacggcgcgggctgctggtccccgctcggaggaggcgcggggggccccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttgtgactgctctagtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaaaggcaaatagtgttatactcttattttttgattaatctgaggaaaggaggtatttagaaactgatgatggtatcactgcaaaaagcattcaactttttttttttgttgagatggtgtttcactctgtcacccaggctggagtgcagtggcgtggtcttggctcactgcaacctctgcctcacgggttcaagtgattctcctgcctcagcctcctgattagctgggattacaggtgcccaccaccatgcccagctaattttttgtatttttggtagagatggggtttcaccatgttgcccaggctggtgtcaaactcctgacctcgtgatccacctcccttggcctcccaaagtgctgggattacaggtgtgagccactgcacctggccagcattcaacttttgagggctaccatatgagctgacagcctagggaaataatcactaggactgaagtatctactctgggtttagaaataacaccaaattttgtaggatgctattatctgggaaagggaaggcagcaagaaacctacaaggcaccaggctagaattcagagggaaagaaatctcaatgcaaaaaaattactgcaaagaaatacaagatagtagtctcaagactaggtagaattccaaactttgagccgacgaatgcatgagatttcagtggccacctgaggaatcagagggcaaacaatggaacattaagtattttcagcccactagaaagctctgtcttctataagcttaagagtccgagtgtctttacaccactgagtgccatgcagagaagggtcattttccttgtatctggggaggctgctgcaccagcttaacatgtgggtgtgatttgaaagttaggttttcagtttggattctttctggatgagctgttctgtctgcccacacctgtagtgctgaaatacagaaagacctctcgggaaaagtttgagtttctcttaatgtctctgtgcttcagtgctagcttatttttggcaacccaatttctaaaaaatgctttcaataacgtgggcttttctttttttctttctttcctttttttttttttttttgagatggagtctcgctgtgtcacccaggctggagtgcagtggcgcgatctcggcttactgcaacctccgcctcccgggttcaagcgattctcttgcctccgcctcctgagtagctgggattacaggcacgcgccaccacgcctggctaattttttgtattttttagtagagacggggtttcaccatactggccagtttttcttatgatggaagacaaaatattgtgtcccagtctagtccacccgtagtgaaatcagtcatttaatcttctcaattcgcatgtttaatgcttaatttttaaataagacattgcttcacaactttgtgtttgaattgataatttgtgcaaatcaggaaaatacgtatttaattaggttgagccatatgagtttgctgatattcgaccattttgtaaaaacaggagtggcaatttcatatggttcaataaaataaaattgagaccgggcacagtggcttatgcctgtaatcccaacactttgggaggctgaggcaggaggatcacttgagctcaggagttcaagaccagactgggcaacatggcaaaaccctgtctctacagaaatacaaaaatgagccaggcatgatggcacatgcctgtagttctagctacttgggaggctgaggtgggaggattgcttgagcccaagaggcagaggttgcgatgagctgagatcatgccactgcaatccagtctgggcaacagaatgagaccctgcctcaaaaaaaaaaaaaaaatacagttgaatgatttttattctcctctttcctttttatctacaataaagtccattttgattttatggtcatccatgggctttggaagtttgaaaaatgctaaacaacctatccaaacccatgagccctcagggtcaactaggctagtgaaggacttaagaataagacctacaccccacagccagagaaagagctttcatagcccctggaagggaagttcttatatcctggggtgaggttgcagacagcagctaccaggcctggcagaggcctgtattatatgtgtgctggagtccagaaccagcacaggattttttatttagcagagttatcttagtaatgaccagtcatgccatataaatctaaaaggcaagacttgttttgttttcatttttgtttttgttttgcagagatggagagataggctgcttgggtctttggttgggtctttataaagctttgcttatcttatattgcttacttaattttggagggaaaaaactaacagacacaccctggtgatggttctttgttcacctcaaggctttgttgttgtgttgttgttgtttgttttttgttttgttttgttttgtttttagatggagtctcgctctatcccccaggctggagtgcagtggcatgacctcggctcactgcaatctccacctcctgggttcaagcgattctcctacctcagcctcccgagtagctgggattacaggcacatgccaccacacccagctaatttttttatatttttagtagagacagagtttcaccatgttgggcaggatggtctcgatctgctgacctcgtgatccacccgcctctgcctcccaaagtgctgggattacaggcgtgagccaccgcccctggccattattttgagttttttttagaaagcttttacaagattacaagaaatgactctcttagggaagaaaaataaccacccagtttcccttcctagtcttagttcaattcatagagtgttgtgtttatccccaaagggtcttgtagtcttcactgcaaacatttgattctgatctactcacatacaaggaaatgtagattgccaagaccaaaactagaggggtgggcttcccatcagggttttcctgtgtggagatgacaggggaaacagggaggaaatcctaattatggcttgtcctcttccctgaattgctgtctacgacagtgtagttccaatgtaaacaaggtgggttggggatggtttgtatagggcaggaggcccacccagaagtcctacccagggaagagagggcccagaatctagttgcagcatttgcccagtaaccctaccccggcctttctttgtgtgttaggaagctggaaatgcaggctggtctccctttcttgcctttgtcactaaccccgagctgtcagccatttggaatcagaactgctttccagtgttctaagtccttatttgattacaaatatttggtgaatcaaagtaaggcactttggtcctaatttttgacctttggtcctaatttttgtttgtaagatgtggagaataaccctgaccttaccaggggtcctgggaatgtgaatccattcgtcaagtggttccacatctagaagaattttgcctatgccatgtcaggcatcattcaacacaaggccaactatctgctgccagtctggcataagatcagattgaaactgctaagtaatggtacatccaaataaacaaagttcttccaagagagtaaacccaagtccatcttatacacgtatttgttctgggttggtggggacgacagttcagccgagtccgatgttctagagcagaggttctcaaccctggctgtgaattaggatcatctggccagtttttgtttttaaatcagtgcaagggccctcccctcagagattcagattcagtagcttcaggtgggacctggaatccatgctttgtttggaacctcaggagtgttcttgatgtgcagccaggattgacaagagcctttagtctagagctcgcagcagacctctagactatttggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttggagccttcgaggaaagagaagggtgacttggggtatgtatggggagaactaaaaacctgtcatcttggttcccacttgtggggaataaagggaaggtattgtcttaactgagctgctaactaatcaagcatgaaggtttctgggaagctgttttgttttttttttttaatttcacctggaattaaattaatagtcccctctggagtcagattttcttttccttcacctatcctcatgcctgagtccacactggattcctcagaataagggtgggcccatttactgctggagcaaagtagaaggttgtggtcctttgctatcacatggtgatggtggtggtttccgtagcaggtaattaaggagatgcacacttttgtatagccctgacagagagaagatgaaagctgctattccttttagtacactttttgagaactaccagaaacctgaactttctctcctagggaagaaaatttggaatttaaataaggccacatttcttcctaggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgattcggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaattaaacacatcttgtcacccagtgctagcaaaaattgtaaagagcaaaaccaaagtttttgatgttagtcttatttttgtaagcagggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaactggtggttttataaaattaacattatagtatgttatataaataaacgttatataaaatgacattaaagtataactgtgaaaaattaaagacttggcgttatccacaacctttatgtgcaataaggaaaactgcagtaggcccccaaagtgccgtctttccctagcattttactcaatgtttgcctttgtgtatgtttagattgctattgtaaagctagccatgtgtgttcctgccctttactgatatttaacacattttctcaaagcttttctttttttaaaaaaacaaaactcaaaataaaacaactaactggctgagctaattttgttttgtattttaaagtaaagtatcatctgttggtagaaggctgtagtgtgatactattcttagtctgtttccctcactgagaggttcttttctgggtgtaagctattcctctccagctttctttaggcctggggttggcaaactacagctggctcctgaaccaagtccagcccactgcctttttttgtaaataaagttttattggcatg

SEQ ID NO: 184695 - DNA, 6094 bp, Homo sapiens
  Payload ID: 16371
  Gene Symbol: SLC9A8
  Gene Name: solute carrier family 9, subfamily A (NHE8, cation proton antiporter 8), member 8
  Uniprot ID: Q9Y2E8
  ENST ID: ENST00000361573
  CDS Start-End: 43-1788
gccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattgga

SEQ ID NO: 184696 - DNA, 6309 bp, Homo sapiens
  Payload ID: 16371
  Gene Symbol: SLC9A8
  Gene Name: solute carrier family 9, subfamily A (NHE8, cation proton antiporter 8), member 8
  Uniprot ID: Q9Y2E8
  ENST ID: ENST00000417961
  CDS Start-End: 211-2004
ccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcagggttttttttttgtgtgtgtctgtgtgtttgtgtgttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattgg

SEQ ID NO: 184697 - DNA, 3627 bp, Homo sapiens
  Payload ID: 16372
  Gene Symbol: SLC9A9
  Gene Name: solute carrier family 9, subfamily A (NHE9, cation proton antiporter 9), member 9
  Uniprot ID: Q8IVB4
  ENST ID: ENST00000316549
  CDS Start-End: 210-2147
aaaagagacagggctgctttaagagagaaacaggaagttgtaactagaagccatctgaatactaagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttctagcaatttttgttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagcagccattctgattactggattggctggggtggggatggaggtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcccagctatttagtaagtgataagtttcttattttgaggacttgactcccatttgctctcagtgaccccagggcagagcccagagaagtgttccgtacccactgctgatggtttcccagagcccacactgagttgaagaacctattgttcttcttggcatccttcttatgctacttctcccatcgctcaaaggggttgcctatggctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctccaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 184698 - DNA, 579 bp, Homo sapiens
  Payload ID: 16372
  Gene Symbol: SLC9A9
  Gene Name: solute carrier family 9, subfamily A (NHE9, cation proton antiporter 9), member 9
  ENST ID: ENST00000474151
  CDS Start-End: 137-579
agaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagagacacttttttcaaaacttaggatctattttaacgtatgccttcttgggaactgccatctcctg

SEQ ID NO: 184699 - DNA, 591 bp, Homo sapiens
  Payload ID: 16372
  Gene Symbol: SLC9A9
  Gene Name: solute carrier family 9, subfamily A (NHE9, cation proton antiporter 9), member 9
  ENST ID: ENST00000474727
  CDS Start-End: 164-349
gaagccatctgaatactaagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatgatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactga

SEQ ID NO: 184700 - DNA, 1879 bp, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENST ID: ENST00000296422
  CDS Start-End: 143-1690
gccccgccccgcccctgcgcggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaa

SEQ ID NO: 184701 - DNA, 1735 bp, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENST ID: ENST00000394789
  CDS Start-End: 123-1550
ggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacagattaatcaagctatccttctgttgtttcttcttcgggaggaatggacgaactgcaaggtagccaagaagtgcgagtacaccaaggaaaggcaataaccgaagccattctgaaactaaacatgtagatgtgtcagaatctgcagtgctcttggaaaagaattcaaaatagcatgtctagtttcatccttgagcttattctttgttactttttacattaattcctttttaatggatccataaaactgtgaataaataacacaataaagccagctctaccaaag

SEQ ID NO: 184702 - DNA, 1184 bp, Homo sapiens
  Payload ID: 16373
  Gene Symbol: SLC9B1
  Gene Name: solute carrier family 9, subfamily B (NHA1, cation proton antiporter 1), member 1
  ENST ID: ENST00000504216
  CDS Start-End: 70-216
gcttacgcaacggtcactgggctcctgggccgctcccgggccagcgagggctgcgaaagaagttgtagcatgcataccacagaatcaaaaaatgaacatttggaggatgaaaacttccaaacatctacaactcctcagttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtgtggcctccgtctttcacccaggctggagtgtggtgtcacgatctcagctcactgcaaactctgcctcccgggttcaagtgattctcctccctcagcctcccgagtacctgggaccacaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgctt

SEQ ID NO: 184703 - DNA, 629 bp, Homo sapiens
  Payload ID: 16373
  Gene Symbol: SLC9B1
  Gene Name: solute carrier family 9, subfamily B (NHA1, cation proton antiporter 1), member 1
  ENST ID: ENST00000511253
  CDS Start-End: 1-384
acaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggtaagaataattagagcacaaaaaatatgaaattcaaaaatatttaagaaaattataaatacatttatttttatttacaatatatctttggctacaacgaccttcttcagaaacacatgttgatacagtgtcatattttcatattgctcttcctttacactgggtgctcttttttttttataaaccaaggacagccctgaatatattccctgagttatctgaagaaataaatataagatttctttcctgagggaacata

SEQ ID NO: 184704 - DNA, 650 bp, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENST ID: ENST00000510243
  CDS Start-End: 2-223
catgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatgttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaaggtgaa

SEQ ID NO: 184705 - DNA, 763 bp, Homo sapiens
  Payload ID: 16373
  Gene Symbol: SLC9B1
  Gene Name: solute carrier family 9, subfamily B (NHA1, cation proton antiporter 1), member 1
  ENST ID: ENST00000514340
  CDS Start-End: 2-763
catgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagac

SEQ ID NO: 184706 - DNA, 568 bp, Homo sapiens
  Payload ID: 16373
  Gene Symbol: SLC9B1
  Gene Name: solute carrier family 9, subfamily B (NHA1, cation proton antiporter 1), member 1
  ENST ID: ENST00000510559
  CDS Start-End: 420-568
acctgggtggcgcgtggcttacgcaacggtcactgggctcctgggccgctcccgggccagcgagggctgcgaaagaagttgtagaaatcaaaggtaatttgaggcttcagctctgtgcagagtgcaaggaaccaaagatgcaaagttgggagtcaccagcatatggaaaactacctagggcaagtgtgctcaccgataacattgcagtgactagtgtaaagcagaggaaaagaagccaacaaaagagatggaagaatagccaatgaagtaggaagaaaatctgaagagtgcagtgacataaaagccgagactggccgggcatggtggctcatgcctgtaatcccagtactttgggaggctaagatgaggaaattgagactcagagaggttaagggtcttgacgaaggacatatacctacatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagac

SEQ ID NO: 184707 - DNA, 1548 bp, Homo sapiens
  Payload ID: 16373
  Gene Symbol: SLC9B1
  Gene Name: solute carrier family 9, subfamily B (NHA1, cation proton antiporter 1), member 1
  ENST ID: ENST00000514972
  CDS Start-End: 65-667
cgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacagttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacagattaatcaagctatccttctgttgtttcttcttcgggaggaatggacgaactgcaaggtagccaagaagtgcgagtacaccaaggaaaggcaataaccgaagccattctgaaactaaacatgtagatgtgtcagaatctgcagtgctcttggaaaagaattcaaaatagcatgtctagtttcatccttgagcttattctttgttactttttacattaattcctttttaatggatccataaaactgtgaataaataacacaataaagccagctctaccaaa

SEQ ID NO: 184708 - DNA, 1399 bp, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENST ID: ENST00000503584
  CDS Start-End: 54-275
ctgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatgttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtgtggcctccgtctttcacccaggctggagtgtggtgtcacgatctcagctcactgcaaactctgcctcccgggttcaagtgattctcctccctcagcctcccgagtacctgggaccacaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacagagatgagatctcaccacgttgcccaagctggtatggtactcctgagatcaagtactccacccacctcagcctcccaaagtgctgagattacaggaatggacgaactgcaaggtagccaagaagtgcgagtacaccaaggaaaggcaataaccgaagccattctgaaactaaacatgtagatgtgtcagaatctgcagtgctcttggaaaagaattcaaaatagcatgtctagtttcatccttgagcttattctttgttactttttacattaattcctttttaatggatccataaaactgtgaataaataacacaataaagccagctctaccaaa

SEQ ID NO: 184709 - DNA, 2300 bp, Homo sapiens
  Payload ID: 16374
  Gene Symbol: SLC9B2
  Gene Name: solute carrier family 9, subfamily B (NHA2, cation proton antiporter 2), member 2
  Uniprot ID: Q86UD5
  ENST ID: ENST00000362026
  CDS Start-End: 163-1776
gaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggaagcgcggattctattactggaaactttgggactgaaaggccaaagcttctgggcccaccatcaacgcagctccgctttcatttctttcacatacaactttccacataagatttcatgcggaaaaaaaaaaaaaactcacaaaggttttatactgataacagtatattaagtgtttactttgtacacagcgtctttgttccagacacttgccatgtctcatttattctcacaccaccaccacagcgtcctttacagatgagaagacaacctcagggagacgatgtatttgcctaggtcccatagctagcaagtgacagcgctgcagtttaagctcaggccgtcttggggagagaccgtgctcttctaccattgcactttaagctgactttaggggaaacacaatctgagttttgacaagtttacttctggcacatgcagtcccgagcactgctttttggctaaaatgcccagtgatgtcaactctgtccctggatttctacaacccgatgagtcaatattc

SEQ ID NO: 184710 - DNA, 3126 bp, Homo sapiens
  Payload ID: 16374
  Gene Symbol: SLC9B2
  Gene Name: solute carrier family 9, subfamily B (NHA2, cation proton antiporter 2), member 2
  Uniprot ID: Q86UD5
  ENST ID: ENST00000394785
  CDS Start-End: 633-2246
cggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatgaaa

SEQ ID NO: 184711 - DNA, 1115 bp, Homo sapiens
  Payload ID: 16374
  Gene Symbol: SLC9B2
  Gene Name: solute carrier family 9, subfamily B (NHA2, cation proton antiporter 2), member 2
  ENST ID: ENST00000506288
  CDS Start-End: 1-1065
gtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggaagcgcggattctattactggaaactttgggactgaaaggccaaagcttctgggcccaccatcaacgcagctccgctttcatttctttcacatacaactttccacataagatttcatgcggaaaaaaaaaaaaaactcacaaaggttttatactgataa

SEQ ID NO: 184712 - DNA, 1826 bp, Homo sapiens
  Payload ID: 16374
  Gene Symbol: SLC9B2
  Gene Name: solute carrier family 9, subfamily B (NHA2, cation proton antiporter 2), member 2
  ENST ID: ENST00000503230
  CDS Start-End: 178-1620
aataggttcatcacaaaagaggacctgagagacaagaatgaatggtttctgactggtggagaaatttgaggataatctcccttgcttgaaaagcggtgattaagattggcacttgcttacaggagtgaaaaacagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttc

SEQ ID NO: 184713 - DNA, 578 bp, Homo sapiens
  Payload ID: 16374
  Gene Symbol: SLC9B2
  Gene Name: solute carrier family 9, subfamily B (NHA2, cation proton antiporter 2), member 2
  ENST ID: ENST00000508136
  CDS Start-End: 92-430
gagaggaatgtaaagaagtgcctaggcctcctgttttattgttttgttttgttattaatcttcattttcttttggaatctgcctaagagttatggcaactgatgatgagaaactaagactaccaatgttaagagttgtgaacagatgtgtgtacagcacaaccaaggcagccgtgattggcctcacaaaatctgtggctgcagatttcatccagcagggcatcaggtgcaactgtgtgtgcccaggaacagttgatacgccatctctacaagaaagaatacaagccagaggaaatcctgaagaggcacggaatgatttcctgaagagacaaaagacgggaagattcgcaactgcagaagaaatagccatgctctgcgtgtatttggcttctgatgaaatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacag

SEQ ID NO: 184714 - DNA, 1911 bp, Homo sapiens
  Payload ID: 16374
  Gene Symbol: SLC9B2
  Gene Name: solute carrier family 9, subfamily B (NHA2, cation proton antiporter 2), member 2
  ENST ID: ENST00000503103
  CDS Start-End: 192-1445
agtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgt

SEQ ID NO: 184715 - DNA, 648 bp, Homo sapiens
  Payload ID: 16374
  Gene Symbol: SLC9B2
  Gene Name: solute carrier family 9, subfamily B (NHA2, cation proton antiporter 2), member 2
  ENST ID: ENST00000503818
  CDS Start-End: 220-648
atttcagatgatctgaagaagggtattggatggaacctatccaataggttcatcacaaaagaggacctgagagacaagaatgaatggtttctgactggtggagaaatttgaggataatctcccttgcttgaaaagcggtgattaagattggcacttgcttacaggagtgaaaaacagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactg

SEQ ID NO: 184716 - DNA, 4172 bp, Homo sapiens
  Payload ID: 16375
  Gene Symbol: SLC9C1
  Gene Name: solute carrier family 9, subfamily C (Na+-transporting carboxylic acid decarboxylase), member 1
  Uniprot ID: Q4G0N8
  ENST ID: ENST00000305815
  CDS Start-End: 254-3787
aagagatgatgggcctgaagctaaccggtgcagactaggggcgagtttggagcaagtaactgtcagtgaggttgcagttggtctgggctgtttggctgtgagcgaaatagctgccccccacttctcacttgcacaccacgggatactcctcctgaggctccggatgattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttagctgaagagatcgtgggtggaatttgttcatatattatagcaagtttcttgtttggaattctaagttcaaaactgattcaattttggatgtcaactgtttttggtgatgatgtcaatcatataagtctcatcttttcaattctgtatctcatcttttatatttgtgagttagttggaatgtcaggaatatttactctggccattgtgggacttcttttaaattctacaagttttaaagcagcaattgaagaaacacttcttcttgaattctggacttttctatcacgtattgcttttctcatggtgtttactttctttggacttctaattcctgcacatacatatttgtatatagaatttgttgatatatactattcattaaatatctacttaacattgattgttttaagatttctgacccttcttttaataagccctgttttgtctcgagttggtcatgagttcagttggcgctggatattcataatggtctgtagtgaaatgaaggggatgcctaatataaacatggcccttctgcttgcctactctgatctttattttggatctgacaaagaaaaatctcaaatattatttcatggagtgttagtatgcctaataacccttgttgtcaatagatttattttgccagtggcagttactatactaggtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaaatacttcttttttcgtatatgccatacaatagtatttactgaggaatttgaacatgttggataccttgtgatattaatgaatatatttccctttataatctcttggatatcccagttaaatgtaatctaccacagcgaattaaaacacactaactactgttttcttacactttatattctagaggcactacttaagatagcagcaatgaggaaggactttttttcacatgcctggaacatattcgagttagcaattacattaattggcatcttacatgtaatacttattgaaatagacaccattaagtatatttttaatgagactgaagtaatagtctttataaaagttgttcaattttttcgtatactacgcattttcaagctcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgtattaaaatatagtttaaatgctgttcttg

SEQ ID NO: 184717 - DNA, 521 bp, Homo sapiens
  Payload ID: 16375
  Gene Symbol: SLC9C1
  Gene Name: solute carrier family 9, subfamily C (Na+-transporting carboxylic acid decarboxylase), member 1
  ENST ID: ENST00000486574
  CDS Start-End: 267-521
agactaggggcgagtttggagcaagtaactgtcagtgaggttgcagttggtctgggctgtttggctgtgagcgaaatagctgccccccacttctcacttgcacaccacgggatactcctcctgaggctccggatgcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctata

SEQ ID NO: 184718 - DNA, 2733 bp, Homo sapiens
  Payload ID: 16375
  Gene Symbol: SLC9C1
  Gene Name: solute carrier family 9, subfamily C (Na+-transporting carboxylic acid decarboxylase), member 1
  ENST ID: ENST00000471295
  CDS Start-End: 89-814
gattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttaggtgagttagttggaatgtcaggaatatttactctggccattgtgggacttcttttaaattctacaagttttaaagcagcaattgaagaaacacttcttcttgagtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaactcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgc

SEQ ID NO: 184719 - DNA, 3979 bp, Homo sapiens
  Payload ID: 16375
  Gene Symbol: SLC9C1
  Gene Name: solute carrier family 9, subfamily C (Na+-transporting carboxylic acid decarboxylase), member 1
  Uniprot ID: Q4G0N8
  ENST ID: ENST00000487372
  CDS Start-End: 223-3612
agactaggggcgagtttggagcaagtaactgtcagtgaggttgcagttggtctgggctgtttggctgtgagcgaaatagctgccccccacttctcacttgcacaccacgggatactcctcctgaggctccggatgattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttagctgaagagatcgtgggtggaatttgttcatatattatagcaagtttcttgtttggaattctaagttcaaaactgattcaattttggatgtcaactgtttttggtgatgatgtcaatcatataagtctcatcttttcaattctgtatctcatcttttatatttgtgagttagttggaatgtcaggaatatttactctggccattgtgggacttcttttaaattctacaagttttaaagcagcaattgaagaaacacttcttcttgaatttctgacccttcttttaataagccctgttttgtctcgagttggtcatgagttcagttggcgctggatattcataatggtctgtagtgaaatgaaggggatgcctaatataaacatggcccttctgcttgcctactctgatctttattttggatctgacaaagaaaaatctcaaatattatttcatggagtgttagtatgcctaataacccttgttgtcaatagatttattttgccagtggcagttactatactaggtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaaatacttcttttttcgtatatgccatacaatagtatttactgaggaatttgaacatgttggataccttgtgatattaatgaatatatttccctttataatctcttggatatcccagttaaatgtaatctaccacagcgaattaaaacacactaactactgttttcttacactttatattctagaggcactacttaagatagcagcaatgaggaaggactttttttcacatgcctggaacatattcgagttagcaattacattaattggcatcttacatgtaatacttattgaaatagacaccattaagtatatttttaatgagactgaagtaatagtctttataaaagttgttcaattttttcgtatactacgcattttcaagctcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgtattaaaatata

SEQ ID NO: 184720 - DNA, 7682 bp, Homo sapiens
  Payload ID: 16376
  Gene Symbol: SLCO1A2
  Gene Name: solute carrier organic anion transporter family, member 1A2
  Uniprot ID: P46721
  ENST ID: ENST00000307378
  CDS Start-End: 722-2734
ctcgctgctgccttgcagtttgatctcagactgctgtgctagcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggacagacatggagaagagaaacaagagaacaggtagtgagaagtcgagagtcagtaattttcttacttaatattgtggggatcttacttaatacataaagttaatgaaactagaaatagtggtttaatatattacttataattcaaaaattaacctatatttacagatgcttacacagtttctttgtgaatccacctatggttttattttaattaattttttattgcaaagcaatgaaatgttgctttgtggagccagatagcattacagcaggtaaatgggtttctgctagatctccacattattggggagatgctcgaagacctcagaatatacacacccttaaggttcaagggctggggttgagctctccataaggaacttttcctcctcccagaagggcgatcattgtgtatatagacatggagacagaaccagaatgacttctgtgggtggaaatagtgccatcagaatcatttattattatgaaataaatattatttatctacattgaaaaaatactactcctcctaaaatcattaacttttcctcagatgattttaagaaatttgagtaatagcacacgaagtggtaaagacccttagtctttctggtatattagaaaagccttttaatcagtctctggaaggacactagggattgcagctgaataaatatattaagaataacaaatcagttcaacaaggagtagagtctgaagtgggattttccgtggaaattctcttatgtctgtactaacaataagaaagacaagacaaagactaagtaattaaagaaaagctcgaaatgttttgtaaccaaaagcttgaaatgttatgtaaccagaatgttatgtaaccagagctgttagatcagatactggctgattcataggtgaacgtcctctttgtgggtcctctcatgcatccccattttcagaatgtaaataatttggctttgtagcccttccaaaaagggtactatcccacttctcctggcataaatcatacattgactgaacgttcaccatctaaaaatcactcatgctccttgaaccaaggtgattatcagagacagctcctggtagaagaggttgtagatgttaaaagagtatgatttctatataagaaaatatagaaattgacagaatggttcttatttactgggcctggagaattcctgttctggcattcttagatccctcaaatttattaccaaggggaaaaggaaaaagaggcaagtaggcagtagggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttacggaaaaacacatgaattcattaggaaataaggtgacagatccccagctgctgaagaactagaatgtctattacactcatacaattgatgttttattttaatacaccagagctaccacacaaaacttccttccatgtgaaaggctccagataaaattctgccatccctcctctcctcatgtcctcctgctcagacccaccttcatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgttta

SEQ ID NO: 184721 - DNA, 448 bp, Homo sapiens
  Payload ID: 16376
  Gene Symbol: SLCO1A2
  Gene Name: solute carrier organic anion transporter family, member 1A2
  ENST ID: ENST00000421294
  CDS Start-End: 150-448
ttatttgatgtaccttttgaaatagaaaaccaacaactaaatcttctctaacaccatgattttctaatctgtattaaagcgttccagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctg

SEQ ID NO: 184722 - DNA, 702 bp, Homo sapiens
  Payload ID: 16376
  Gene Symbol: SLCO1A2
  Gene Name: solute carrier organic anion transporter family, member 1A2
  ENST ID: ENST00000421287
  CDS Start-End: 550-702
agcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattc

SEQ ID NO: 184723 - DNA, 356 bp, Homo sapiens
  Payload ID: 16376
  Gene Symbol: SLCO1A2
  Gene Name: solute carrier organic anion transporter family, member 1A2
  ENST ID: ENST00000416627
  CDS Start-End: 318-356
agcaatcagcgagactccatgggcgtaggaccctccgagccaggtgcgggatataatcttgtggcgcgccgttttttaagcctgttggaagagcgcagtattcgggtgggagtgacccgattttccaggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaata

SEQ ID NO: 184724 - DNA, 2008 bp, Homo sapiens
  Payload ID: 16376
  Gene Symbol: SLCO1A2
  Gene Name: solute carrier organic anion transporter family, member 1A2
  ENST ID: ENST00000458504
  CDS Start-End: 258-1874
cttttgaaatagaaaaccaacaactaaatcttctctaacaccatgattttctaatctgtattaaagcgttccagggtagaagtaagacatatcaagatttaaaacataaatagcttggaacaccctgaagagcaacatgggagaaactgagaaaagaattgaaacccatagaataagatgtctttccaagttgaagatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataa

SEQ ID NO: 184725 - DNA, 562 bp, Homo sapiens
  Payload ID: 16376
  Gene Symbol: SLCO1A2
  Gene Name: solute carrier organic anion transporter family, member 1A2
  ENST ID: ENST00000435179
  CDS Start-End: 299-562
gagactccgtgggcgtaggaccctcagagccagtgagatgaacccggtacctcagatggaaatgcagaaatcacccgtcttctgcgtcgctcacgctgggagctgtagaccggagctgttcctattcggccatcttgggggagctcgagattattaaccaaaaaatttcctgtccaaaagctgtgttctttagtgggaaagtcttgcagaactcccctctgaactaatactggaagcaaagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatg

SEQ ID NO: 184726 - DNA, 543 bp, Homo sapiens
  Payload ID: 16376
  Gene Symbol: SLCO1A2
  Gene Name: solute carrier organic anion transporter family, member 1A2
  ENST ID: ENST00000413682
  CDS Start-End: 447-543
aggatatttttagacctcccctacctcaatagagacccatggtgtgttgtaaaagtgtgttttctttacagaagctgtgttctttagtgggaaagtcttgcagaactcccctctgaactaatactggaagcaaagaagtaagacatatcaagatttaaaacataaatagcttggaacaccctgaagagcaacatgggagaaactgagaaaagaattgaaacccatagaataagatgtctttccaagttgaaggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggca

SEQ ID NO: 184727 - DNA, 569 bp, Homo sapiens
  Payload ID: 16376
  Gene Symbol: SLCO1A2
  Gene Name: solute carrier organic anion transporter family, member 1A2
  ENST ID: ENST00000450590
  CDS Start-End: 297-569
aagattataacctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcatt

SEQ ID NO: 184728 - DNA, 717 bp, Homo sapiens
  Payload ID: 16376
  Gene Symbol: SLCO1A2
  Gene Name: solute carrier organic anion transporter family, member 1A2
  ENST ID: ENST00000453443
  CDS Start-End: 308-717
gttcccaagattataacctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaac

SEQ ID NO: 184729 - DNA, 559 bp, Homo sapiens
  Payload ID: 16376
  Gene Symbol: SLCO1A2
  Gene Name: solute carrier organic anion transporter family, member 1A2
  ENST ID: ENST00000445053
  CDS Start-End: 346-559
gaaatagaaaaccaacaactaaatcttctctaacaccatgattttctaatctgtattaaagcgttccagggtagaagtaagacatatcaagatttaaaacataaatagcttggaacaccctgaagagcaacatgggagaaactgagaaaagaattgaaacccatagaataagatgtctttccaagttgaagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgatta

SEQ ID NO: 184730 - DNA, 559 bp, Homo sapiens
  Payload ID: 16376
  Gene Symbol: SLCO1A2
  Gene Name: solute carrier organic anion transporter family, member 1A2
  ENST ID: ENST00000430803
  CDS Start-End: 19-23
agcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgggtagaagtaagacatatcaagatttaaaacataaatagcttggaacaccctgaagagcaacatggg

SEQ ID NO: 184731 - DNA, 580 bp, Homo sapiens
  Payload ID: 16376
  Gene Symbol: SLCO1A2
  Gene Name: solute carrier organic anion transporter family, member 1A2
  ENST ID: ENST00000422327
  CDS Start-End: 139-580
gatgtaccttttgaaatagaaaaccaacaactaaatcttctctaacaccatgattttctaatctgtattaaagcgttccagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcag

SEQ ID NO: 184732 - DNA, 2382 bp, Homo sapiens
  Payload ID: 16376
  Gene Symbol: SLCO1A2
  Gene Name: solute carrier organic anion transporter family, member 1A2
  ENST ID: ENST00000544290
  CDS Start-End: 414-701
gtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattgatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataact

SEQ ID NO: 184733 - DNA, 2322 bp, Homo sapiens
  Payload ID: 16376
  Gene Symbol: SLCO1A2
  Gene Name: solute carrier organic anion transporter family, member 1A2
  ENST ID: ENST00000544020
  CDS Start-End: 239-520
gcttggaacaccctgaagagcaacatgggagaaactgagaaaagaattgaaacccatagaataagatgtctttccaagttgaagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattgatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccc

SEQ ID NO: 184734 - DNA, 2229 bp, Homo sapiens
  Payload ID: 16377
  Gene Symbol: SLCO1B1
  Gene Name: solute carrier organic anion transporter family, member 1B1
  Uniprot ID: Q9Y6L6
  ENST ID: ENST00000256958
  CDS Start-End: 97-2172
gacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccattggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattca

SEQ ID NO: 184735 - DNA, 2840 bp, Homo sapiens
  Payload ID: 16378
  Gene Symbol: SLCO1B3
  Gene Name: solute carrier organic anion transporter family, member 1B3
  Uniprot ID: Q9NPD5
  ENST ID: ENST00000261196
  CDS Start-End: 68-2176
aggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatggatcttcttccaacctcccattaagatcctgcagaagaaatagaaatattcaaatattgcaaggtgtaattgtgagacaacttattataatacgtgttaagtttctactggacccatggaagtggattaagaaaaaccgactttagcttgagaaagcaaaa

SEQ ID NO: 184736 - DNA, 2805 bp, Homo sapiens
  Payload ID: 16378
  Gene Symbol: SLCO1B3
  Gene Name: solute carrier organic anion transporter family, member 1B3
  Uniprot ID: Q9NPD5
  ENST ID: ENST00000381545
  CDS Start-End: 220-2328
gatggacttgttgcagttgctgtagcattcaaagtcaagttgtgctttgcgatgctgagtttactgttttaaatggacttcaagcatagccctgaagtgttgtcccgttgttcccacctcctagagggcctgacagaagaggtacatatgctatgtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 184737 - DNA, 1002 bp, Homo sapiens
  Payload ID: 16378
  Gene Symbol: SLCO1B3
  Gene Name: solute carrier organic anion transporter family, member 1B3
  ENST ID: ENST00000540853
  CDS Start-End: 129-1002
gtgagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaa

SEQ ID NO: 184738 - DNA, 1771 bp, Homo sapiens
  Payload ID: 16378
  Gene Symbol: SLCO1B3
  Gene Name: solute carrier organic anion transporter family, member 1B3
  ENST ID: ENST00000544370
  CDS Start-End: 1-1440
gggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggcagaagtatcctgcaagtgacattaagacaactagattatctggaagaaacaaaaagctgctgcaattgtaccttacctcttatagaagcattaatttgtaatttatatattgatcaatatataaatttgatttctgaaactataagtattagaactactcatagtagaatttcttttaattatctaggaagaataaatgtgtttgtaagtatgacccaaatgcctgaaagtataatagaaaaataatggtgaaaggatttatattgctttgtgtatatacccaataataggactgatgggttgaatggtaattctgttttatgttctttgagaaatcgtcagactgctttctacaatgacagaacttatttacattcccactagtagtgtataagcgttcccttttctccactatgtcttcagtatctgtta

SEQ ID NO: 184739 - DNA, 1923 bp, Homo sapiens
  Payload ID: 16379
  Gene Symbol: SLCO1B7
  Gene Name: solute carrier organic anion transporter family, member 1B7 (non-functional)
  Uniprot ID: G3V0H7
  ENST ID: ENST00000421593
  CDS Start-End: 1-1923
atgaaaatatcaaccactcaaatagaaaggagatttgagatatcctcttctcttgttggtttaattgatggaagcttcgaaataggaaatttgtttgtgattgtatttgtaagttactttggatctaaactacacagaccgaagttaattggaattggttgttttcttatgggaactggaagtattttgatggctttaccacatttcttcatgggatattacaggtattctaaagaaaccaatattgatccatcagaaaattcaacatcaaacttaccaaactgtttaattaatcaaatgttatcactcaatagaacaccgtctgagataatagaaagaggttgtgtgaaggaatctgggtcacacatgtggatctatgtcttcatgggtaatatgcttcgtggcataggggaaacccccatagtaccattggggatttcttacattgatgattttgcaaaagaaggacattcttccttgtatttaggtactgtgaatgtaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaactttttgttgggagtcctcgccctacctgctgttgcaattggcatgttttcaggaggatatatcattaaaaaattcaaattgtctttagttggacttgccaaattggcattttgttctgcaacagtgcatctcttatctcaagttttatatttctttctaatctgtgaaagcaaatcagttgccggcctaaccttgacctatgatggaaatagtccagtaagatctcatgtagatgtaccactttcttattgcaactcagagtgcaattgtgatgaaagtcaatgggaacccgtctgtggaaacaatggaataacttacctgtcaccttgtctagcaggatgcaaatcttcaagtggtaataaagagcccatagtgttttataactgtagctgtgtggaagtaattggtctccagaacaaaaattactcagcgcacttgggtgaatgcccaagagatgatgcttgtacaaggaaatcttacgtttattttgtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 184740 - DNA, 506 bp, Homo sapiens
  Payload ID: 16379
  Gene Symbol: SLCO1B7
  Gene Name: solute carrier organic anion transporter family, member 1B7 (non-functional)
  ENST ID: ENST00000545916
  CDS Start-End: 1-300
gtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggttgattccatgccttggataatatgaatacatgccttggataatatgaacagtgctgcaataaacatgaaagtgcagaatgactcttcaacatatttatttcattttctttggccatatacccagtagtgggattgctggatcatatgatagatctatttttaaatttttgaggagcttccatactgtttttcataacccctgtactaatttacattaacaactgtgtataa

SEQ ID NO: 184741 - DNA, 3365 bp, Homo sapiens
  Payload ID: 16380
  Gene Symbol: SLCO1C1
  Gene Name: solute carrier organic anion transporter family, member 1C1
  Uniprot ID: Q9NYB5
  ENST ID: ENST00000266509
  CDS Start-End: 369-2507
gcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacaggaa

SEQ ID NO: 184742 - DNA, 2414 bp, Homo sapiens
  Payload ID: 16380
  Gene Symbol: SLCO1C1
  Gene Name: solute carrier organic anion transporter family, member 1C1
  ENST ID: ENST00000539415
  CDS Start-End: 280-420
tttatcacgtgtggccttaaacttgcagcaaattgcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacata

SEQ ID NO: 184743 - DNA, 2529 bp, Homo sapiens
  Payload ID: 16380
  Gene Symbol: SLCO1C1
  Gene Name: solute carrier organic anion transporter family, member 1C1
  Uniprot ID: Q9NYB5
  ENST ID: ENST00000540354
  CDS Start-End: 249-2240
attgcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtact

SEQ ID NO: 184744 - DNA, 2557 bp, Homo sapiens
  Payload ID: 16380
  Gene Symbol: SLCO1C1
  Gene Name: solute carrier organic anion transporter family, member 1C1
  Uniprot ID: Q9NYB5
  ENST ID: ENST00000545604
  CDS Start-End: 231-2423
aaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgt

SEQ ID NO: 184745 - DNA, 2868 bp, Homo sapiens
  Payload ID: 16380
  Gene Symbol: SLCO1C1
  Gene Name: solute carrier organic anion transporter family, member 1C1
  Uniprot ID: Q9NYB5
  ENST ID: ENST00000545102
  CDS Start-End: 295-2133
aagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgc

SEQ ID NO: 184746 - DNA, 4223 bp, Homo sapiens
  Payload ID: 16381
  Gene Symbol: SLCO2A1
  Gene Name: solute carrier organic anion transporter family, member 2A1
  Uniprot ID: Q92959
  ENST ID: ENST00000310926
  CDS Start-End: 275-2206
acacctgtctgagggggcggcggcggcggcggcggcggggcgggggctcgtagcgcctttgacacccgaggaaaagagggaggagggagagcgcgtttcatcatcggcggcggccacttataaaaacttctaggcgcgcactcgctggctcagtctccgctccgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaagccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaaaggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatatttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaggtaa

SEQ ID NO: 184747 - DNA, 1918 bp, Homo sapiens
  Payload ID: 16381
  Gene Symbol: SLCO2A1
  Gene Name: solute carrier organic anion transporter family, member 2A1
  ENST ID: ENST00000493729
  CDS Start-End: 113-1816
cgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaagccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtattttt

SEQ ID NO: 184748 - DNA, 1937 bp, Homo sapiens
  Payload ID: 16381
  Gene Symbol: SLCO2A1
  Gene Name: solute carrier organic anion transporter family, member 2A1
  ENST ID: ENST00000481359
  CDS Start-End: 122-1369
tctccgctccgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattgcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgt

SEQ ID NO: 184749 - DNA, 4494 bp, Homo sapiens
  Payload ID: 16382
  Gene Symbol: SLCO2B1
  Gene Name: solute carrier organic anion transporter family, member 2B1
  ENST ID: ENST00000289575
  CDS Start-End: 396-2525
aaaaggacaggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttatattctggtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 184750 - DNA, 2368 bp, Homo sapiens
  Payload ID: 16382
  Gene Symbol: SLCO2B1
  Gene Name: solute carrier organic anion transporter family, member 2B1
  Uniprot ID: O94956
  ENST ID: ENST00000428359
  CDS Start-End: 168-2231
atatctctaaaggataaagtactcccaggaaggctttgagccttggcagaaaaggctgggattgaagcttcagggagagccagaggtgaggctggagtgggagatcacctgaggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaa

SEQ ID NO: 184751 - DNA, 3219 bp, Homo sapiens
  Payload ID: 16382
  Gene Symbol: SLCO2B1
  Gene Name: solute carrier organic anion transporter family, member 2B1
  Uniprot ID: O94956
  ENST ID: ENST00000454962
  CDS Start-End: 249-1697
ccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgta

SEQ ID NO: 184752 - DNA, 373 bp, Homo sapiens
  Payload ID: 16382
  Gene Symbol: SLCO2B1
  Gene Name: solute carrier organic anion transporter family, member 2B1
  ENST ID: ENST00000534004
  CDS Start-End: 243-373
atttgggcaaggccccacttgctcccagaagcccagcagggagagcttcataggccatggagacagacccagctgaggagcagctgcagggactccaggagaacgcagccatggcttggggactgcagtacggcaggaagggtgggatggatgcctcctctcggggcacctcacaggacagatgagaatgagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 184753 - DNA, 274 bp, Homo sapiens
  Payload ID: 16382
  Gene Symbol: SLCO2B1
  Gene Name: solute carrier organic anion transporter family, member 2B1
  ENST ID: ENST00000525845
  CDS Start-End: 144-274
aaacagccatatctctaaaggataaagtactcccaggaaggctttgagccttggcagaaaaggctgggattgaagcttcagggagagccagagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 184754 - DNA, 578 bp, Homo sapiens
  Payload ID: 16382
  Gene Symbol: SLCO2B1
  Gene Name: solute carrier organic anion transporter family, member 2B1
  ENST ID: ENST00000531713
  CDS Start-End: 316-578
aactgcagactgggaggttactaagtccttagcagctgagtacagaacacgatggaaatgaaaacatggtacaacagaggttacagccctctcctgacctgataaacttcatgatggagctaaagatggtttgggaagtttctttgaatcacaagcagaactgtatgtgctgtctcctcctgtctggatctactcactacttgctaaagagaagaattttggtttgggataaatttatgtggatcttcgctttggtgccataaagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcag

SEQ ID NO: 184755 - DNA, 577 bp, Homo sapiens
  Payload ID: 16382
  Gene Symbol: SLCO2B1
  Gene Name: solute carrier organic anion transporter family, member 2B1
  ENST ID: ENST00000534186
  CDS Start-End: 197-577
agccatatctctaaaggataaagtactcccaggaaggctttgagccttggcagaaaaggctgggattgaagcttcagggagagccagaggtgaggctggagtgggagatcacctgaggcaggtgagcaggctccatgagtgggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccct

SEQ ID NO: 184756 - DNA, 2593 bp, Homo sapiens
  Payload ID: 16382
  Gene Symbol: SLCO2B1
  Gene Name: solute carrier organic anion transporter family, member 2B1
  ENST ID: ENST00000532236
  CDS Start-End: 401-2182
aaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagc

SEQ ID NO: 184757 - DNA, 649 bp, Homo sapiens
  Payload ID: 16382
  Gene Symbol: SLCO2B1
  Gene Name: solute carrier organic anion transporter family, member 2B1
  ENST ID: ENST00000526839
  CDS Start-End: 1-444
gtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtgagcctcaggagcacatgtttgctagaccctagctaactgactgccactctcataggagacattgagccaggggacctcggttcaaatcctagcagcaccactgaccttgggcaagtctcttagcctctctgaacctcagctttctcatctgtgagataatctctgtcctgtctgtctcctaaagctgtgatcagagtccagcgagatggtggagataaactgtaaagtgccatcaaa

SEQ ID NO: 184758 - DNA, 224 bp, Homo sapiens
  Payload ID: 16382
  Gene Symbol: SLCO2B1
  Gene Name: solute carrier organic anion transporter family, member 2B1
  ENST ID: ENST00000530556
  CDS Start-End: 94-224
aacgaagaggcacacaggaggtcggagaacacaatatcaacagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 184759 - DNA, 2121 bp, Homo sapiens
  Payload ID: 16382
  Gene Symbol: SLCO2B1
  Gene Name: solute carrier organic anion transporter family, member 2B1
  ENST ID: ENST00000525650
  CDS Start-End: 268-1965
caagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcag

SEQ ID NO: 184760 - DNA, 546 bp, Homo sapiens
  Payload ID: 16382
  Gene Symbol: SLCO2B1
  Gene Name: solute carrier organic anion transporter family, member 2B1
  ENST ID: ENST00000527180
  CDS Start-End: 96-546
attttacccaatccctactcaagatgaagatggagatggagatggggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccct

SEQ ID NO: 184761 - DNA, 5115 bp, Homo sapiens
  Payload ID: 16383
  Gene Symbol: SLCO3A1
  Gene Name: solute carrier organic anion transporter family, member 3A1
  Uniprot ID: Q9UIG8
  ENST ID: ENST00000318445
  CDS Start-End: 215-2347
ggaggaggaaggggcgatcgcggcggcggcggcggcggcgaggagctgtgccttccacctctccagccccggcaggacgggggcggccgccgcgaacccggggcggggacagcacgcagcctcgaggcgcgcacccccgcccggcagcggccccgacacccggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagagcccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccacttgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaattaaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaatttcaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagagtgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtagcatctctgataacgaatagacccacaagctcctggaagctgtcgtgtgtccaatgcgtgaaaatgtctgtgacattttcagtgttagtcttgaactaaggcccttgtctgtgtgttttgaaggtgggtgaacctcagagaatgaacctgttatgatttggggtaagaatcacgttggaaaacctctcgcaaccagcacactaggccttctacggccatttctgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtaccgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccacttcataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaa

SEQ ID NO: 184762 - DNA, 2705 bp, Homo sapiens
  Payload ID: 16383
  Gene Symbol: SLCO3A1
  Gene Name: solute carrier organic anion transporter family, member 3A1
  Uniprot ID: Q9UIG8
  ENST ID: ENST00000424469
  CDS Start-End: 54-2132
ggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagagcccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctgagggcctggccctcttcctcttcctggagagaacagcccaccaccacccacagacctcgcgggcctcacttagcgcgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcgtttattttccaaatgagcagtttagaaatatgtgatgtaaagtacatactgtacgtttgctgaaaattatattaaaagcactattttaattctt

SEQ ID NO: 184763 - DNA, 567 bp, Homo sapiens
  Payload ID: 16383
  Gene Symbol: SLCO3A1
  Gene Name: solute carrier organic anion transporter family, member 3A1
  ENST ID: ENST00000553304
  CDS Start-End: 176-567
cttccccagcccggctctcgagcggccgcctggcccgacgagggggccgcccggcgctgggggcaggcgggcatgacctcggcccggcgtggaggttggcgagtggtgcagaggcggccgccgggggagctgccggccggggctgccagcgagcgggtagcgggcgggaccgttgatgccggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcat

SEQ ID NO: 184764 - DNA, 524 bp, Homo sapiens
  Payload ID: 16383
  Gene Symbol: SLCO3A1
  Gene Name: solute carrier organic anion transporter family, member 3A1
  ENST ID: ENST00000555892
  CDS Start-End: 67-330
cttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcacagagtaccaagacattgagactgagaaaacctgccccgaatcacattcaccttcagaagactcc

SEQ ID NO: 184765 - DNA, 640 bp, Homo sapiens
  Payload ID: 16383
  Gene Symbol: SLCO3A1
  Gene Name: solute carrier organic anion transporter family, member 3A1
  ENST ID: ENST00000555210
  CDS Start-End: 1-328
tgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctg

SEQ ID NO: 184766 - DNA, 2776 bp, Homo sapiens
  Payload ID: 16384
  Gene Symbol: SLCO4A1
  Gene Name: solute carrier organic anion transporter family, member 4A1
  Uniprot ID: Q96BD0
  ENST ID: ENST00000217159
  CDS Start-End: 206-2374
ctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctgcg

SEQ ID NO: 184767 - DNA, 2665 bp, Homo sapiens
  Payload ID: 16384
  Gene Symbol: SLCO4A1
  Gene Name: solute carrier organic anion transporter family, member 4A1
  Uniprot ID: Q96BD0
  ENST ID: ENST00000370507
  CDS Start-End: 97-2265
gacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 184768 - DNA, 856 bp, Homo sapiens
  Payload ID: 16384
  Gene Symbol: SLCO4A1
  Gene Name: solute carrier organic anion transporter family, member 4A1
  ENST ID: ENST00000451793
  CDS Start-End: 1-456
actacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 184769 - DNA, 3092 bp, Homo sapiens
  Payload ID: 16384
  Gene Symbol: SLCO4A1
  Gene Name: solute carrier organic anion transporter family, member 4A1
  ENST ID: ENST00000497209
  CDS Start-End: 131-1993
gcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 184770 - DNA, 5334 bp, Homo sapiens
  Payload ID: 16385
  Gene Symbol: SLCO4C1
  Gene Name: solute carrier organic anion transporter family, member 4C1
  Uniprot ID: Q6ZQN7
  ENST ID: ENST00000310954
  CDS Start-End: 288-2462
cccacgccgcgccttccggttggtccttgaggcgacgggtgaggcacagctgagcgccaaagccacaggctggggcgctaacgcccccgctcagcgctctgcgctccagacagctgcgagctggagtaggaaggttcaggcggtggcggagagtgcgctggaggctggagggccaggaggcgggaagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccaatgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaagggtgaaatgggaaaagagaagactgttttacacctggaaaatttacctcgatttttaagaacacacattgccatggcaggattatctatccaatatggacaatcatatttacaaaattgatgtttttataatcaaatgtatttttttacttatgtagtttttgttttatgcaagaaacagacctgtgccttcaaagcccacgtaaagcctcaaaacacagcacacacacacacgagcacacacacacacacacacacgaacacacacacacacacacacacgcacacatacacacttatttcctattcccattgtctaggtatgaaatcctcaagcaataacaagaaaaaaggcccacaattagaaaaatttacatttaaaaaaaatgttgtttctatccccattacaacttgtttaattttaattttcattgtcaatattttgagcttagaacatttatggtataaaaatttaaactaatcaaagttgtgtgatgatttccgggaattattattgaaagcctatgaatttaaaaccaggtttaccatgtaatttgtttttaaatttatgtatactagcctggcctttctccaagcaaattattgaactattagaatatgttagttatcatccttgtgtcttagtatatagtgaatacagaaacatcagcattgtatacacatattttcactttaactcaagaattccaggaggtaatttgttgatattacaatttttaacacatttatgattctgtgataatattattcaattgcatatatttcagaggaaagtaccagtcagtaaagaaaaatgccaactaaacatgaaactattgatcaatacttatatacctttaatttttcctatttgaaaagccaaccacttaacacattactcatagcacctaagacagtgccttgcatagtgtagtcatctattattattgtttaattagaatattaaaccctaccctttaactcagcagtccccaaccttttttgcatcagggaccatttttgtggaagacaatttttccatgggggaagaaggtatggttttgagatgaaactgctccacctcagaccatcaggcattagttagattctcataaggagagtgcaacctagatcccttgcatgtgcagttcccaatggagtgtgcactcctatgagaatctaatgccactactgatctaacaagaggtggagctcaggcagtaatgctcactcacctgcctctcagctcaccaactgtgtggcccgattcctaacaggccacacacagcccagggctggggacccctgctttaactgatgcattgatttgataaagtattttacaagcctgataatgttataaccctgtttattcaggtcagatttatgccaactttgctgagaatatggagggtatagatgagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaa

SEQ ID NO: 184771 - DNA, 9076 bp, Homo sapiens
  Payload ID: 16386
  Gene Symbol: SLCO5A1
  Gene Name: solute carrier organic anion transporter family, member 5A1
  Uniprot ID: Q9H2Y9
  ENST ID: ENST00000260126
  CDS Start-End: 708-3254
gtgcgcgtgtgtctgtttggagcggaggagaggcttgggtgacaggcgaggggtggggggaagagttcagcctgagtcacagtctcattcactgatttctcttcggctggacggaggctgcctcctcacgcggctcccaactattcccgtagctcagtgcccccctcccgccgctctactcagccaggcagacagactgacagactcgctagtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaaagaggaagctgaactttccatccagtactgttgatagcattttaagccatagcagttataaatcaggtagagtttttcaaatgcttcagaggaaccataggcatagtgtgatagaaggaacagctacttcaggtcgtaggacacattctctttcagtctgcctgccccatcctaagataaagaggctgctgaatcataaatctgatagcttaaatataaactccagtattcttttgtaaggagcattaaaactagtgtgctaaacaatatggctagaaactgtaatttgaaatgcataatagggaaagaaaatgacagctttctcatccaagaaaattgttgcagaaattttctttagctctacgggcccacaaagtcactgggaaaagtcccacctgagtattttagttacatcttgaaagcactggcaaatctgtgtggttttctttttttctggacagaaaattgctgtggttgctcctgaaaatgcatacttatatcaggaaatctgtgcctgggatatgaaaatcacttagaatacaggaggagggagatctgtgttctggaacagaatatgatcttaagtaattgttgaaaattatgtaaaataaaccagtccatccgaaagaaccctactttatcagagatagaatcgttttacactaccctttgattcccccttactgtaagtttctggcagtgattctgagagaggatttttctgttcctaaatgcactttgggttcattacccatcattcttttcagtacctcccagcacatcactttgaagtaagcatcatagagaatgctttctacatggctcttaagatagatgcttcctgacggcgctaacggattgacagcaagttagctcaggggttctggctgccagggagtgtaagggccaaatgctgatataattgtgaactttttctgccaaggagcctatggtcatggagggctaattagggaaatgtttttctcttctggtttacccttatccccagaagagatgtgattgacagactgttccatgattcaggcttctgctctccaaccttgcttgactgcacaggtggaattgtgcaaatactcctgggtataaggctgtttccctctcttcctaggaatgacattggtcaaacagttctcttggttgcatacagtttgtgttaacactgttagactgaacaatgtctacaaggggtggagctagtggtctcaggggctaaggacttccctctggttcctgggcttggctctcggggaggtgaggattcttgcttggttaagactgtaattgcactggtaattgtcagactctggccaatgtggcatatattggaagtattcaaaaaatcttgctgattaagaaaaccttgctgattgaactagtgtctcctttggggcctcagggttcccctttaccctctatgggagagctctgatcctttaaaggagaaattttcctttggtgtgggagttaaagatatgtagattggagaggtgtggtgttttcttaattttcttctgatcattaagatactgcattgagagaattttggtgggattggcactttttctggtagctaagattgctggactcagcacggagtagttagagagcccccttactccctttgctgccatgaacagtcatccagtttggcgatcactgatcaggtgccaggtatcttcaggtgtcatattacctgattaccatctgccactccataaaatcctttgggatgattgggccagaactcaaagaaatgggcctgaaatgtgcaccacagtgttaatattgtacttcctcaagtatctgctccttataaatagcaggtatttcattaatgtgttgttggtgaatgtagactaagtagtaaaaatcatgagaaaataaagctttggaatatgtaccaattaagagtggttcacaaaatacttggggctatggtagcatcactggaatattacatagccaactgaagtgactgttttgtagatgataccatttaattgtatatatagggtcttatatgtttcttaataaattgatcccattactttatagtcacagctcctattagaagttttaatgaagactctccatgagcttaggcttcaaattacttgttttggaaaaggtcatcttgtcctttataaactgtaaattcatatattatttagctttaatatgcaaatacaatatccttgagttcatcctattaatttagaaactcccaggaggtaagatgggtggttggagcgcattctttggttattttcattagcattaagtccttattctttataggtggatttaattcttgaaaatattcaaaagtaattcagagtcaaggtgttggggatggagagaaaggaggaacagagaggaaaaaaattagcatttgttgagtgttgacgatttgtagagcattttgacaagcacttaatatacatcatcattcattttgatcctcttaattaccttgcaaagatttgattctttttttttttttgagacagagtcttgctctgtcacccaggctggagtgcagtggcttaatctcagctcactgcaacctccgcttcctgggttcaagtgattctcctgtttcagtctcctgaggaactgggattaaggtgtgtgccaccacacccagctattttttttctatttttagtagagagagggtttcaccatgttggccaggctggtcttgaactcctgacctcaagtgatccacctgccttggcctctcaaagtgctgggattacaggcatgagccaccatgcccggctgattttattatttttttaaaaaacatatgaaaccaagactcagagaagtaaaataactcatttaggatcatacagaatggtaaagtcaggattcagacatagatttctctcactccattattcattttttacactacgcaatgtatacaatagcttttggttaacaaaggcaaggtgactataaaatcgtgagattaaagcatttcaattttttgatatattaccgtttatgaagagtagagaggtttttttgtgtaaataaaaaaaactgtaggaaacatctgtaggaaatatcaagatttaatgtttaactagattttcaaggtaaatttacatttatttagctaagtgttatattaaagttatttgtcataacatacctcaaatatttatttatagttcatatttaatacagaacaaatctagtcttcgtgttaacatcgggtctcggcagagtttctgaaatgaaacattatgaagaaaggtagttcagatttgttgaatctgagctttagggatttcaagtgtatttttttttattttcctctttcagaatattaacatctctattagttttttgatgaatatgagttttaagattcctaataagggttttaagtgaacacacataaaatacatatcaaaccactgatcccgattgttccctttagtcgctgtgacattgttacctttagtggcatgcacttggaaatgtcagccttcagagaagggggagttacatggagtaaggcctcatggatgtcatggtggtcctccatgttcaccaaccaccaagaaaattcttcttcagtccacaattccagcttgcgctctttggtgcacttggagccagaaagtgtctttttggccctgttttgtagaaaccgtgcatgtaccaaagagaaactttagagtttggatggagctgaagcattgatgggaattccctagtgcacccaggagcaggaggcaagcccaagcctcgggtggtagccaattatattttgtgatcgtgtatgtacttaaaacatcagagatgacacagcacatgaatataactattgatatgtaggtgcatactgagtattctaagtagcagatagataccaaaatactgtataatcccagaattgcctaaactgcaggtttgctagttctctgttatacagaccagtaggtagcctttccacacatttgtgttttctcttccataataagagagtgctgcggctggcaggcaaaggtagttgcctcatgcactttatctttttgtctttttctcttcttcatcttttgggatgctgctggctgtatctgtcccaaacttcttgttgcattagaatcagatctgtgtatgtttgaggaggttttattttaaagacttcagttttactcagctctaggaagggtcaaatacaacaacaacaacaaaaaacagaaaacaaaaaaccctccctaggtgtttgcttttgcaacattaaaaaaaatgccttggtgctaaaaagtatttaatgacgcatgttcaccactaaaaagcgccactgaattcacagtatttcactgctaagtggctgcatgtactttgtgtttggaaatctgaagaattttccagaaaacaagcatccattactctcatttcaacagttactccatctatgctgcaaaaatgaagcgtgaaaggggggatacttttctatggaatactcagtgcttttgatatttattttagcaagaataatcagatgccaaaaataatttcagagaaaggtagaaaaaatatttcaggtaaccttttcttatttcttctccaaaaagattacacccatgtaaggtatttttaacactggggttttgaaggtgttatcttttctggtatcctatcactacatgttaaaattgaaggagaaaatattattgaaactaaagtaattgcagggacacattaaaccaaaggggtgaacaaaagaggtttaaagtttgtatctagaaatgaaaaataagaatcattggtaagactagtaccgattattggcaattggtaattgataattggtaagagtagtaccaaataatgggcatttttcttaaaatacatacctctaccccaaaccccaaatgttaatttagaatcctgaaacaggcaagtcaggctctgactcttttgtttaaggaaatgtaatactgtgtcaactaaactggcattaggttcttagtggagtgtgtgtttgtgtgtgtgtgtgtgtgttttgtgtagaggtatgtttgtgatgaaaggttttgcactgttgcataaagaagtttgattttgtgatttttaaaatgatattcatttggagactttttaaggtaatttaaaagatgtataatttccgtgtgtttaatgaaatctgttgtcgatgtactaatcttggtttacagcatcttgaatacttgattattgaaaattaagaaaaaagttaaaaatgaataaagtgtgttggactgaa

SEQ ID NO: 184772 - DNA, 2630 bp, Homo sapiens
  Payload ID: 16386
  Gene Symbol: SLCO5A1
  Gene Name: solute carrier organic anion transporter family, member 5A1
  Uniprot ID: Q9H2Y9
  ENST ID: ENST00000530307
  CDS Start-End: 43-2424
tgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagaggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaaga

SEQ ID NO: 184773 - DNA, 2650 bp, Homo sapiens
  Payload ID: 16386
  Gene Symbol: SLCO5A1
  Gene Name: solute carrier organic anion transporter family, member 5A1
  ENST ID: ENST00000526750
  CDS Start-End: 503-1441
tcgctagtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaa

SEQ ID NO: 184774 - DNA, 3725 bp, Homo sapiens
  Payload ID: 16386
  Gene Symbol: SLCO5A1
  Gene Name: solute carrier organic anion transporter family, member 5A1
  Uniprot ID: Q9H2Y9
  ENST ID: ENST00000524945
  CDS Start-End: 718-2781
agacaatgagggagagtctccgccgaccgcctgctgcttattgttccgggactggagactgcagccggctgctgcctagtcctccggggctccgctcctgactagctcctccgtccctctagggacggttcggggtcacctaaccctggtccccggggcgctgggacgctagccccaagccgcagccgctcttcgctgaccgccctctttctgctttgcaggtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcagcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctg

SEQ ID NO: 184775 - DNA, 2437 bp, Homo sapiens
  Payload ID: 16387
  Gene Symbol: SLCO6A1
  Gene Name: solute carrier organic anion transporter family, member 6A1
  Uniprot ID: Q86UG4
  ENST ID: ENST00000379807
  CDS Start-End: 136-2295
gcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaagatatttgcgaagaaataaaggttgtcagtggttgccagagcagtggtatatcattccaatcaaaatacctgtctttcttcatccttgggcagactgtgcagggaatagcaggaatgcctctttatatccttggaataacctttattgatgagaatgttgctacacactcagctggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtattctccaagatttgtttctgtgcccaactttcagaagaggaaaatcacacattatgtttacataagtagcaaaaatatatttatggtgatctgcattttcataataaagtgtcctattgtgaaaca

SEQ ID NO: 184776 - DNA, 2340 bp, Homo sapiens
  Payload ID: 16387
  Gene Symbol: SLCO6A1
  Gene Name: solute carrier organic anion transporter family, member 6A1
  Uniprot ID: Q86UG4
  ENST ID: ENST00000389019
  CDS Start-End: 173-2146
tttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaaca

SEQ ID NO: 184777 - DNA, 2689 bp, Homo sapiens
  Payload ID: 16387
  Gene Symbol: SLCO6A1
  Gene Name: solute carrier organic anion transporter family, member 6A1
  Uniprot ID: Q86UG4
  ENST ID: ENST00000506729
  CDS Start-End: 173-2332
tttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaagatatttgcgaagaaataaaggttgtcagtggttgccagagcagtggtatatcattccaatcaaaatacctgtctttcttcatccttgggcagactgtgcagggaatagcaggaatgcctctttatatccttggaataacctttattgatgagaatgttgctacacactcagctggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaacatttctgataatgtttttaatgtatgtagaatttttaggatttactgggagaattaaagtttaataattttagattatttacatttcttcttaatattctgctgtctagaaatattaaaaattatacaactaggaaataaagtaaaataataacattcaaagcc

SEQ ID NO: 184778 - DNA, 432 bp, Homo sapiens
  Payload ID: 16387
  Gene Symbol: SLCO6A1
  Gene Name: solute carrier organic anion transporter family, member 6A1
  ENST ID: ENST00000511588
  CDS Start-End: 1-78
ctaaatgagaacactgacttcccagatgtaactgtgaagaatccaaaagttaagaaaaaagaagaaactgacttgtaactggatcatcattgtcaggattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaacatttctgataatgtttttaatgtatgtagaatttttaggatttactgggagaattaaagtttaataattttagattatttacatttcttcttaatattctgctgtctagaaatattaaaaattatacaactaggaaataaagtaaaataataacattc

SEQ ID NO: 184779 - DNA, 1611 bp, Homo sapiens
  Payload ID: 16387
  Gene Symbol: SLCO6A1
  Gene Name: solute carrier organic anion transporter family, member 6A1
  ENST ID: ENST00000513675
  CDS Start-End: 70-1470
gttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaaggtattgcagaatgtacatcaatgattggatatgctctgggttatgtgctaggagcaccactagttaaagtccctgagaatactacttctgcaacaaaaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtattctccaagatttgtttctgtgcccaactttcagaagaggaaaatcacacattatgtttacataagtagcaaaaatatatttatggtgatctgcattttcataataaagtgtcctattgtgaaac

SEQ ID NO: 184780 - DNA, 3801 bp, Homo sapiens
  Payload ID: 16388
  Gene Symbol: SBSPON
  Gene Name: somatomedin B and thrombospondin, type 1 domain containing
  Uniprot ID: Q8IVN8
  ENST ID: ENST00000297354
  CDS Start-End: 206-1000
gggcagccccgccacccgcccgggcctcgacgggcgcgccgccagggctggggaggggcggcgcggagggcgggggccgggcgcagggcagggcccggctgtgcctcgccggccgctcgggcagctcccgggccgcggccagccgaggatcagagcgcttgccccgggggtctgtcgcgtcgcaggcgccgccggagccctggccatgaggaccctgtggatggcgctgtgcgcgctgtcgcggctgtggcccggggcccaggccggctgcgccgaggccgggcgctgctgtcccggccgggaccccgcctgcttcgcccgcggctggaggctggacagggtctacgggacgtgtttctgcgaccaagcctgtcgcttcaccggggactgctgcttcgactacgacagggcgtgcccagctcgcccgtgcttcgtgggggaatggagcccctggagtggttgtgcagaccagtgcaagcctacaacccgtgtgcggaggcgctcggtgcagcaggagcctcagaacggcggggcgccctgcccacccctggaagagagagctggctgcctggagtactccaccccgcagggccaggactgcgggcacacctatgttcctgcctttataactacctctgcattcaacaaggagagaacacgacaagctacgtctccacactggtctacacacacagaggatgctggatactgtatggagtttaagacagagtccttgactcctcactgtgctctggaaaactggcccttgactagatggatgcagtatctccgagagggatacacggtgtgtgtggattgtcagcctccagctatgaactctgtgagccttcgttgttctggagatggcctggactccgatggaaatcagactctccattggcaagcaattggtaatcctcggtgtcaaggaacttggaaaaaagttcggcgagtagaccagtgttcttgtccagctgttcacagttttatttttatatagatggtgatataaatatttccaaatgcatttgtaaacattctaaatattctcaagtcatgttcaatgtttcctaaaccttcaattttggccaaagtccccaaacacatcattgccacactctgaagtagagaaagaaaatttaggggccagttctcaaggaacacaggtcctttatttttattttaactaagttgaagacccactcaaaaagctcttgtggttttatgttcttgacctttcaactggagtcctctcattcagcaggtggcccgtgagacacagaatacatgtctgtttgctaaagtaaaattactgtaactcagtccgattattggtgacggaagtgtcatttaaggggatctatgttttgaaccttgcagtctattttataatcttttaaaagtttctcactttaaaacatgtatacaggtatgcacactctacacatatatttccatatatttaatattccataaattctgaaataatttcaagcaaattatcacaaataatttttccacagggcaaattatttaaaattttagtaagcattctgtaatgaaaaaccaagttatactaaaaacattttttgaagaagaaattttttttttgcttaagaagtgaaaggatcaaatgctcattgtaggtcaatgggagttcttttaaatgttataattttcatgaaaagaaatgttgacaccagtgaatgaaacaattgctttcattctgaaaattctaccaccatttgcatctaagattatttccaaggcttaaagcctgaagctgaataaaataatctttcagagtccagcttcaagtttagttgatgtaagctcactatttttttcctaccgcatgcattttctaatgtttggggtggatggtgtgtcggttatggaaggcatagacgtcattacaggtgctacgatctcacacacacacaaggaaatgttagtctccttattttatgattggaaaatcaatgacctagaggcaaaatggcatgtttaaggacctgggatgacaagtcattctgcagtcagccacagagccaaatttggactcctcaaccagaactccatgaaaagcctgactttgccaaacactgtgctggaaaagctaagcccctttcatttgtgaagtaaattttaaattcaagatatttagtttagagaattgagtcttgagatgtaaactacatgagatttctttggtttcaattgaataatattcactaacaaatgatttactaaaatacgtatttcttggtccttatcatgtaatgacagattcacaacagcaataaggatggagatttccccaataattaataacaccgagagtagcaatattttttactgtattttcatttaattgtcaaagttgtttttgtggaaaattaaattcttcagaaattaataataaaatatgtgagtctcatcaaggctagcaactttaagtcagtattaacattttcatactgtttctaacatttattaagctagatttttgaagctatgtctgggtaatttccaatgttacttaaaagtttttttttctttgagacagagtctcactctgttgcccaggctggagtgcagtggccccatctcggctcactgcaagctccgcctcccgggttcacgccattcttctgcctcagcctcccaagtagctgggactacaggcgccgtcatcacgcctggctaattttttgttttttttttttagtagagacagggtttcactgtgttagccagggtggtctcgatctcctgacctcgtgatccacccacctcggcctcccaaggtgctgggattatgggcgtgagccactgcgcctggcctgttacttaaaatttttatactagtaaataaactttttgttcacatttataaaagctctatatttgtttgactagaaaataacccaaattttctggaccagtcagagaatgataaaatttcaccaaaaataaaacaaaaaaatccttcagaactgataggtataggtacaacaactactaatagcaataaagcaatggtgcttttatagttccgatatgtgttataacatttaacataattgaggtgtataaaataaatttttcaccttatgcatttaatttttggtggatgaccagtaattgctttcttattgaagttaaatttttgttatttctattcttgagaaaattttatgggctagaggagttaactgttaaataacagttttgaaaagcttgttattaattttagcaaagcccaagggaaatagttcagaactgaaacatgtagtccaagtgatgaatgaaaaaccaaaagtttttattttcaaatttaaaaatcaaagtatataagacctcttggcactcttttttaataagtaccttagtcttagggccctatccccaggcactctaaaaagatttacgaactctaaaatcccttaatagactgattttcaaaagtgctcatggaaaataattcgaacaaaaataaatacagccaccaggaaagaagggaaaagaagcaagggataatggccatttttgaagagaaaagtgaaaaacaagtgaaggaaaaaaagaatagaaaaaggaataaggtaactataatcacagtattctttttggagttttgctttggtttttattcgagaatgttacaattaagcataaaccgcaacagcaataatttaaagtgtttggttatcatctggcataaaaatttcagttagctatcttttctagatgtgcacaaaattgatgttaataaaactggttcctgccctctaagaa

SEQ ID NO: 184781 - DNA, 618 bp, Homo sapiens
  Payload ID: 16389
  Gene Symbol: SST
  Gene Name: somatostatin
  Uniprot ID: P61278
  ENST ID: ENST00000287641
  CDS Start-End: 109-459
agcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaaatgtgaa

SEQ ID NO: 184782 - DNA, 4295 bp, Homo sapiens
  Payload ID: 16390
  Gene Symbol: SSTR1
  Gene Name: somatostatin receptor 1
  Uniprot ID: P30872
  ENST ID: ENST00000267377
  CDS Start-End: 618-1793
tggtcatcgcacggcggcagctcctcacctggatttagaagagctggcgtccccgcccgcccaagcctttaaactctcgtctgccagaacccgccaactctccaggcttagggccagtttccgcgattctaagagtaattgcgtgggcacctgtgctggggccaggcgcaaagaagggagttggtctgcgcgaagatcgtcaacctgctaacagaccgcacatgcactttgcaccgaccatctacgtctcagtctggaggttgcgcactttggctgctgacgcgctggtggtgcctattaatcatttaccagtccagagccgcgccagttaatggctgtgccgtgcggtgctcccacatcctggcctctcctctccacggtcgcctgtgcccgggcaccccggagctgcaaactgcagagcccaggcaaccgctgggctgtgcgccccgccggcgccggtaggagccgcgctccccgcagcggttgcgctctacccggaggcgctgggcggctgtgggctgcaggcaagcggtcgggtggggagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggtcaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggacactgacagcctttgatggaggaacccaagaaaggcgcgcgacaatggtagaagtgagagctttgcttataaactgggaaggctttcaggctacctttttctgggtctcccactttctgttccttcctccactgcgcttactcctctgaccctccttctattttccctaccctgcaacttctatcctttcttccgcaccgtcccgccagtgcagatcacgaactcattaacaactcattctgatcctcagcccctccagtcgttatttctgtttgtttaagctgagccacggataccgccacgggtttccctcggcgttagtccctagccgcgcggggccgctgtccaggttctgtctggtgcccctactggagtcccgggaatgaccgctctccctttgcgcagccctaccttaaggaaagttggacttgagaaagatctaagcagctggtcttttctcctactcttgggtgaaggtgcatctttccctgccctcccctgtccccctctcgccgcccgcccgccaccaccactctcactccacccagagtagagccaggtgcttagtaaaataggtcccgcgcttcgaactccaggctttctggagttcccacccaagccctcctttggagcaaagaaggagctgagaacaagccgaatgaggagtttttataagattgcggggtcggagtgtgggcgcgtaataggaatcaccctcctactgcgcgttttcaaagaccaagcgctgggcgctcccgggccgcgcgtctgcgttaggcagggcagggtagtgcagggcacaccttccccggggttcggggttcggggttcggttgcagggctgcagcccgccttggctttctccctcacccaagtttccggaggagccgacctaaaagtaacaatagataaggtttcctgctccagtgtatctcaaaagaccgggcgccaggggcgggggacctagggcgacgtcttcagagtccgccagtgttggcggtgtcgccgcaacctgcaggctcccgagtggggcctgcctggtctctagagggttgctgcctttcaagcggtgcctaagaagttattttcttgtttaacatatatatttattaatttatttgtcgtgttggaaaatgtgtctctgctttccttttctctgcttgcctagccccaggtcttttctttgggaccctgggggcgggcatggaagtggaagtaggggcaagctcttgccccactccctggccatctcaacgcctctcctcaatgctgggccctcttatctcatcctttcctctagcttttctatttttgattgtgttgagtgaagtttggagatttttcatacttttcttactatagtctcttgtttgtcttattaggataatacataaatgataatgtgggttatcctcctctccatgcacagtggaaagtcctgaactcctggctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacatcatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggttgattgtttaagccagagtgtattacaacaatctggagatactaaatctggggttctcaggttcactcattgacatgatatacaatggttaaaatcactattgaaaaatacgttttgtgtatatttgcttcaacaactttgtgctttcctgaaagcagtaaccaagagttaagatatccctaatgttttgcttaaactaatgaacaaatatgctttgggtcataaatcagaaagtttagatctgtcccttaataaaaatatatattactactcctttggaaaatagatttttaatggttaagaactgtgaaatttacaaatcaaaatcttaatcattatccttctaagaggatacaaatttagtgctcttaacttgttaccattgtaatattaactaaataaacagatgtattatgctgttgcaa

SEQ ID NO: 184783 - DNA, 7683 bp, Homo sapiens
  Payload ID: 16391
  Gene Symbol: SSTR2
  Gene Name: somatostatin receptor 2
  Uniprot ID: P30874
  ENST ID: ENST00000357585
  CDS Start-End: 370-1479
tcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaaaaaaaaaaaaaaaaaaaaaaggaaaaccacaatgcgtactaaagaccagaagacattgttcacaaaacaaaagcaccctcacctgccaatgaatatgcagcgtgcagggggtgtggtgtgagtgttggtggggccccacctctcggagatactgctgtgctgccttcctcactgactgtatacatagtaactgtcatatctttaatgccatggactcactgagccgctctgcaaggactattgtagacaggcacttcacaccataaagtggcatttttttcgttccccaaactgacatttacaagcgataagaaaagagacaatatccatttcattgactgatcattttctagagtatgaagaaatacacacctgggtgtctgcaaggatgtcatcatctttgggtttcatctgagagcatcactcagcatctcacacatagatgttaccatatttttaaatgagctttcctcatccggctccctaagcaagcgctgttggccggtgggagtgactaagtgctccacctgtgggtgtccttcttaatgtgctgcttttgttctgtataaattcacaccacctcactcccaaaagtacttcctgtggctcagaaaaatatgttcaataagattttggatagataaatccatacaaaaataaaaagaggtatagttataaaacaagactacagaaaaagttgtggcagaaattgcatgcaggaaaatcccacaccattagtaaaagtaaggtcaactgtaagttcagctcagggcttcctagcagccatgtttagcgaagtgtgatttttttttttaaacaaaaacaagcaaagatttggaagaaaatgctttagacctaactttacaattattataacataagatgttccagggtccttgaataaatgctgagttttagggaaatgattccaagggaccaagaattggtagaaataatttcaaggcagagaagactaattctacaggccgggcgtggtggcttatgcctgtaatcccacactttgggaggctgaggtgggtggattgcctgaggtcaagagttcaagaccagcctggccaacatggtgaaaccctgtctctactaaaaatacaaaaaattacccaggcatggtggcgggcgcctgtaatcccagctacttgggaggctgagacaggagaatggcttgaacccaggaggtggagattgcggtgagctgagatcgtgccattgcactccagcctgggcaacaagagcgaaacttcatctcaaaaaaaaaaaacaaagactaattctatagtacccatgaccctgcaaccagagaaactgcctgtagggaggccagagtccaaagcagccacctgtaacctgaaaatgaaacgcagacccaggcatctgtgggtcttcatcagcaggatgaccattctaaggctaaaagacaggcctttaaatctgatgctataattccatccaaatacacagttaggtttctaccatagggaaagctattctctactttttgaagtatctgtttcaaagataacttgctctctggttctcttttatctaaaagagagaatcaacatgctaatttaaaggttaacatcattttaattcaaaaattttagtctccattccatatttaatgatgaagacaaatctgctgggtgctgggagggaataaaaagtaatgcaccccattgatttcagagtatctgatcacttgggttatgcaagctgctacttacccgccattagcatgggtagttaagtgctgattaaacctaagtggactcagtgaaaaagatattgggaaaaataatatgatattgtggcctatgttgaatgatgttagcttgtgtttcagtaacagagttgggtaatactggacgtgtagatgaagctttagcagggctgggcacggtggctcatgcctgtaatcccagcactttgggaggctgaggcgggtggattacctgaggtcaggagttcaagaccagcctggccaacatggggaaaccctgtctctactaagaatacaaaaattagctgggtgtggtggcgtgtgcctgtaatcccagctactcaggaggctgagacaggagaatcgcttgaacccgggaggcgaaggttgcagtgagccaagatcgcgccactgcacttcagcctgggtgacagcacaagactccatctcaaaaaaaaaaaaaaaaggaagaagaaaaagaaacttaagtggggttcatacatagcatggcagagggacactggagaataaaatggcatgcagagaggaacacgcgggccagtggatgaggcttctagacctggcagtgaactggagtctatttgcttacacaaatttaaccttctctccatgatggaatacaagtgtttcttgccaaaactcgcagccccagctgccctagatgaggagcaccgtgctggaaaagtgcacaggctgatcacagagacaggtaggaagcaatggactgttaaaatgcatgttccgggctggggatggtggctcacacctgtgatctcagcactttgggaggccgaggctggggaatcgcttgagcccaggattttgagactagcctaggcaatatggtgagaccctgcccttaaaaaaaaaaaagaaaagaaaagaaaagaaaaaaagattcatattcctgatcagctctgaatgtgactattcaatgaagacagtaaagttacagtgtaaggcacacatgacctttggccttgctaaagaagagtggctgaaggtctagcaaattaatgcttgtcttaggttacctgttgatttaaaaacaacaacaacaaaaacccataaaaatagtaaaatataaaaacaaattagtgttttatagaccctggggaaaagaattttcagcaaagtacaaaaatttaaagcattcctttctttaattttgtaattctttactgtagaacagctcaaaatatcagttctgttttaagtaacagaattgataactgagcagggaaacgtaatttggattgtaaaattcttgctttaataaaaattctttaaacagtcaaaatagaaagaaagaaagaaaggtggcaagagaattatcaaaagtttccatagatggttgggaagatctgattagtgtttccaaaatgcttatcattctaagaatcccaatagctggcaagccaagcagtggaacttatagtaacaacaatcaatcacttgtctcatcccacatttttgccaaattcaaaaacaccaaatttcccatcaaatgttctgtcagagtaaacctttacctaagtgcttgttttgcttttaatatgtgaatttctgggaacattcccatgggcagcctctaattttttttttttttttttgagacagagtttcgctttttcacccaggctggagcgcagtggcacgatcttggctcactgcaacctccacctaccggattcaagtgattctcctgcctcagcctcccaagtagcagggactacaggcacgtgccaccacgcccagctaatttttgtatttttagtggagatgggtttttgccatgttggccaggcaggtcttgaactcttgacctcaggtgatccgcctgcctcagtgtcccaaagtgttgggattacaggcacgagccaccgcgctcagccaatttttcctcaactctctctttcctggacgggctgcgttggggggaggtgcagggaaagaacacctctttgcttagacattggtgtcgacagtggggatactaagttcatctcctgatcctgctaggcctggaagcaggaaagaaatgtcctggttagagataaaattgttctatccttttagaaaagcctgttaaggaatatgatgcaaagccaccttcgacgaaatctgaaatgataccccacagccttgtccaccccaattattcagtgacagggctccagttgcttaagccatagagaaggcccctttgcagtgggagtcactgaagacagaaagggaagcccaggatgaacccagtcctaagggctgctgggggccaccaaataagactgttttagccctggacacagagggagacacagtcatcccagatccttacaaagaatacattgccaaggaccccgaaggaaatctgcttgtcttaagagaggaagacccacgaccagctctctgggactacctgtcaactcagcaggtgcagccagggagcagccatgcttcttctgccctcccagtaggctgggctatcagttcctgggaggggtcctgtccccatgtaaggggatatgtacattgctgagtacgctgatatctttttcatgggtatgattttttaacaagaaagctaaatggttctcgtgtaacataactgatatagtttggctgtgtccccacccaaatcttatcttgaactgcagctcccataatccccaggtgttgtgggagggacccagtgggaggtaattgaatcatgggggtggttaccgccatgctgttctcgtgatagcgagtgagttctcacgagatctgatggttttataaggggctttccccctccttcgctctgcacttctccttgctgccatgcgaagaaggatgtgtttgcttccccttctgccatgattgtaagtttcctgaggcctccccagccatgttaaactttgagttaattaaacctctttcctttataaatta

SEQ ID NO: 184784 - DNA, 4100 bp, Homo sapiens
  Payload ID: 16392
  Gene Symbol: SSTR3
  Gene Name: somatostatin receptor 3
  Uniprot ID: P32745
  ENST ID: ENST00000610913
  CDS Start-End: 535-1791
tccctgtcacgcatctctcatcactccccctcattctgcctttcctcctactcacggtctcctctccctctccctctctctctctccccctccctctttctctctctctctctttctccacctcctcccgaccccctttcccctctatttctattggcttctgtgtcccttgctcccctcttctcttcctcaccctgggaagcttctcccccctatccttgcccctgcccccccaggatgtgtcctggagatggggggtgacgtaccaggctctggttgggaagtcagggccggagaccagatgggagaggctctgtggacagccgtggccgagggcctgggagggaacctgagcccgcaagcggtctagaagtgggtgccttgtggggaccctagttaggagtgccctgggggcacctggggactgggcagggagaggggacagcagaatgataaccagcctggcggcaaggagggaagccctcaccccatgggcaggcaaatagctgactgctgaccaccctcccctcagccatggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtaggggcctggggaaagccaggatggcccgaggaagaggcagaagccgtgggtgtgcctagggcctacttcccaaggtgccacaggcccatgatgggatgttgaggggcctggactttgatgctattgctgccaggtcttgctgtgtgaccttgggtaggttgcttctactctctgggccttgttttctcctctgtgactcagggataggagtcatcagcctggatgagctatgtcagatgagaggtttggagggcactgttgctgggctgacctggctgagcaggcaaaaggtgggtgcagactggcctccccccagggatggagtgtcttggggcatcaactagaatcttggccctcagagggataaaccaaggccaggatttcttgggctcagagtcaggaacacaggagctgctgggggctgggctggaaacctaaacagaagaaagcctaacccggtgggaggagtggggcagaaatggtcaggccccagatcagctccctcccctcgactgtgaggccttggaccagctctgctcctctctaggcctcaggcttcacctgggtaaaacccaacaacctctacacccttttggcccaggcagtcaatgctggaggtcctgtgctcctggacgggaagagcaggtgaatttcctgctcatggaagcgaatgaagtccagcttcagggtctctcactgcctgggcttttgcaaggccctgcatctacttttgtacttgtcattttgtattcgttttcttaaagagggacctcgaactgcataagcttaggccacccaaagcctggctctgcccctgctgaggtcagccacccaatccccaaggaagctcatgttgggtcttatggctggagtaggggcccccgggggttcccaggtcttttgagggcttccaggcacctccttgtaggaagggccatccctgttcctctccttgtgacccatattctcccttcctggagaccgagacagggacccagcccatgaggactggcatggaaaggcagagtgtctgaagagcgctgtgaggagaaggaagaggaagggagaagaggaagaggaaggagaaggaagaggaagacaagggggaaaggggaggatgaggagggggaaggagaagtacagatctgtttcctggagccgtctttggcccccctgggctgagctcagtggtagcatctgtgaacctgagttgccgacaacagccccacccaaccagtactgagggaaggacacgatcagggtggaacagccagggtgcaatggcaaatgcacagagtacagacaggcacagggcctgcgtccctgaggggcctcagagtgctgccaagagggctcaggccttaataaagccctagggtggagctggctaccagggacattgggaggactggggagctccctccccatgctctatcatcctggagactacaggtcgggaggcccagggaagacaagaagaggctgaagtgggactgtggagggggaccatggggagcagccaccatccaaggctgggcctagactccctcccagagatggtccctcagagctgtggtgaggctggccctgggagggtgagacccccggtgaaatccttccgcttccccaccccttgcagagggcaggggtcctcagggaaagcacaggaaccagacttttggagacttggatcttcagcacacctcagggtcctgggctggcattggccttccgggcctcaatttccccatcaacaaatggagatgaatcccagcttggctgcctcctgggatctaacgagaaaatgagtcatgtgaggtaacttccaggctcactgcaatgggtacggtggggtgtatcagattataaagtgggggtgccctcctcacccccaggcttggcctatacccccctctccatcaagtggcctctctgtgtctgtcctttggggtgaggacactgtaggccatgagaaatgggcagttggggggtcagaggccaagggttagggaggcagggcttggggagagtgtgggaccatcagaagagaaggaagtttacaaaaccacattttgtgtggagatggaggctggaggcccggccctgggacttggtctggggtttcttgaggaagatctgagggtccaagggaggaaggatgccctggccttctggccttctctggctgatcctgccttcttgctgcctaggacaggagagtaatgtcctagaatggtccctgggaggccagttaggaaaccctttgctgcttctgtctctagctcttgtcaataaagacggtgacacctg

SEQ ID NO: 184785 - DNA, 1781 bp, Homo sapiens
  Payload ID: 16392
  Gene Symbol: SSTR3
  Gene Name: somatostatin receptor 3
  Uniprot ID: P32745
  ENST ID: ENST00000617123
  CDS Start-End: 458-1714
tgagtctgaggcttccatccggggacaatgtcccaccttggagctctccttgttgaacggcttggctgttcacatttatggctgttctgggtgatgtcctaggttctggggttaagaaataaatcattcagggcccctgccttcaagagccagtgttctagcgggtgggagatgggcaaatggagaatgattggggtgcctggcctccctgaactgttagggctgtgcggctcaggacagccactcaccctctctgtgctgtctcctcctgaacagtcctccaaggagtccgcccccagctttcaggcaagcttgtgccaaagataaaccagacagggaggaaaagtccctccttctcaaggatgaactagatcatgcacaggattccagctctaaagaaaagacggcacctcaattgcaggcaaatagctgactgctgaccaccctcccctcagccatggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtaggggcctggggaaagccaggatggcccgaggaagaggcagaagccgtgggtgtgcctagggcctactt

SEQ ID NO: 184786 - DNA, 1427 bp, Homo sapiens
  Payload ID: 16393
  Gene Symbol: SSTR4
  Gene Name: somatostatin receptor 4
  Uniprot ID: P31391
  ENST ID: ENST00000255008
  CDS Start-End: 99-1265
gtctgcgcgccagcccccgccctgggcccgccgcccgagctctctggcgcagcgctagctccgccgcgctcagctgccctgcgccggcacccctggtcatgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccaacatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaccaggctggtgctgatggtcgtggtcgtctttgtgctctgctggatgcctttctacgtggtgcagctgctgaacctcttcgtgaccagccttgatgccaccgtcaaccacgtgtcccttatccttagctatgccaacagctgcgccaaccccattctctatggcttcctctccgacaacttccgccgattcttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctgaggagcccttcccctacccaccctgcgtggccacctcccaaggggtgggcaccattcctacagccccgaagactgcatctcctgaatgctcacctaagctccaccacctgttccttccagcagcccatgtacctgccggagagtgtcagaactcttctgctgc

SEQ ID NO: 184787 - DNA, 1362 bp, Homo sapiens
  Payload ID: 16394
  Gene Symbol: SSTR5
  Gene Name: somatostatin receptor 5
  Uniprot ID: P35346
  ENST ID: ENST00000293897
  CDS Start-End: 89-1183
atgcctgcatgtgctggttcagggactcaccaccctggcgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccacccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccggcggtggtgtgaggacagagctggctgaagccaggctggggtagacacagggcagtaggttccccaccgtgaccgaccat

SEQ ID NO: 184788 - DNA, 7477 bp, Homo sapiens
  Payload ID: 16395
  Gene Symbol: SON
  Gene Name: SON DNA binding protein
  Uniprot ID: P18583
  ENST ID: ENST00000300278
  CDS Start-End: 30-6941
ggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagggccgggttaaacggcagggccgggttagacgacagatgaaacaacccgcagcttctcatttgacagtaactcgatgcaattcactttgtggaaccaagccacaaagtgaaaagcatcgaattgcagagaacagtgttatcacatccctacccaacattgggccctccctgcacttgtgggaaggtagtccaaggtacaactatttagcttcccgatttgcttcaaggctctatagctctagattttggtggtagcaaatttatcgggtggagggattgatcggagagggcagatcctcaggttcaacacaagaactggattggaaaaggtcattgtaggttgatgtgagcatcttgggtacatagcccattgcccttaatgatggtttcttactgtttctctgggttgtttgtcagatagcctttaattttaattatttttccttccctttgctaccttggcccttttaaattcttgtgtttaacctaatgctcagccttggtactccattcccttctccttcccctctttgctactattaaaagtcggagaagtggaattcaaacgttgaaatttccacggggctatagttgtatcttaataatgccaagtgtcaaaacaaccccattaaaatgccgcctgattaaataatgtgctgctaaatatagtgcacatgaaaacagcaagactgtatatatatgtaaatatatatatatatctgtatctttgtatgtatctctgtatctgtacctttgctgtatcttttaataaacagtttacttttatttaa

SEQ ID NO: 184789 - DNA, 8813 bp, Homo sapiens
  Payload ID: 16395
  Gene Symbol: SON
  Gene Name: SON DNA binding protein
  Uniprot ID: P18583
  ENST ID: ENST00000356577
  CDS Start-End: 476-7756
ctcccggatgcatatccctgtcgaaactgaacttggcgccacctgagagcgcctgaaagccgtgtgttaaacaccgggttgcccttcttgctcttcttcctcttcgcctttaatctcaggcacttagcaagcctgttaaggctcccaaacactgctggggactgacaacttatgcggacacggtcgcctcaagagagacggctcctgtaatggcgcctgcgtcagacactaacatggcggacatagtcgtgcgcggcgcaaacgtcagcacctctaccccagccgctcagaaacagcagaggagagcagggccgtgctcactgattggtccctcggtggagcgggccggaccgggcattccctttggagccaatcaggaaggcgagagaccgaattggcccgtgcgcctcctcccgaggcatgctgggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaa

SEQ ID NO: 184790 - DNA, 7860 bp, Homo sapiens
  Payload ID: 16395
  Gene Symbol: SON
  Gene Name: SON DNA binding protein
  Uniprot ID: P18583
  ENST ID: ENST00000381679
  CDS Start-End: 29-6355
gaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagttttagaagccaaactgactgaggagtgggacggttcgtttgaatggaggaggtgttgagtgagcaacacgcagaagctcgcctacagtttcgtttccattcacgacgcgttcactgatcgccacgagtatactgcatatacgcaaagacacagacaatcttcagaaatgatcttttgccaccggagcttggaaattaataagaatagctggccattgcctgaaaggaacttctttcgcatcaacatttcgggttttggctgtttggtaccagccattggcgataatggccggccattatcagttcttcctgcggttcgggttttggcagtaacatatatattttaaacacacttatttttgtttttaaaagtttgatcttttcaattgaggcttttttggggctttgttttattactatttttttggtgtgggtggatggggggagatgctaaaatattgctgctaggatccagaaataccacactgtttcatatattggaacttgttattggctagccttatgccagcctgccactgtcaatatattctgttccccttggttacaagcttaatatactcttgtgtttttggcgaaatgagctttttatcctattgtaatattttcaattgataatagatgtcattaaatctactgcttgtatagagacaggtgtacccaaatttactcttgacctttttataaagccaggtaatggagtctgttcctttgcatctcaggaaggaattgactttgctttatgtatcagacctcatcaattgcaccctctccatcatgccttattttcctaagttctccttaaagaaactcaacccacaaaacatttatggagagacatgttgctatctaatcctgttgcaaatatttcagatcttttgttttgccatacatctgggaaaatgtaaagcttctgaatctgtttcctcacttagatttattacaatatgaattacaactttttttaaaaaattaaggaccttgtaaacgcttctattgcttatttacctaatccaagctccttatccaaaatgctaaggacagttagtattttgctgttttcggccccatcttcagccttcttgtcccaagtttcttctcacctttttaccaccacctgactaggatgacttctcctttccctaccagtctttgttctttactatgaaaatctggcttagaactcttcaaggaatattccttgattctctaactctgcctgactattctctcttaagcctttgttcttttagcacttatgtactcagtttgtattatatcagtttgcacttgttattgtgttgctctgtaaaagtgttcaattatttcatgtatatgtattccttctcttgtactagattgtaagctccttgagagcagggaccatgtcttctactttttttttttttttttttttttgtattccccagacagtgcccagtacagtgctctctctgcacatagtaggtgctcaataaatgttgttgactgac

SEQ ID NO: 184791 - DNA, 2463 bp, Homo sapiens
  Payload ID: 16395
  Gene Symbol: SON
  Gene Name: SON DNA binding protein
  ENST ID: ENST00000381692
  CDS Start-End: 42-1406
gaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaa

SEQ ID NO: 184792 - DNA, 8394 bp, Homo sapiens
  Payload ID: 16395
  Gene Symbol: SON
  Gene Name: SON DNA binding protein
  Uniprot ID: P18583
  ENST ID: ENST00000455528
  CDS Start-End: 30-7007
ggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaagggccaaatccttgtagctgtcttcttgccccggtcagtgccagccgtactattcacaacactgctgctaccgaggcctaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaa

SEQ ID NO: 184793 - DNA, 5269 bp, Homo sapiens
  Payload ID: 16395
  Gene Symbol: SON
  Gene Name: SON DNA binding protein
  ENST ID: ENST00000436227
  CDS Start-End: 1-4364
aacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaa

SEQ ID NO: 184794 - DNA, 684 bp, Homo sapiens
  Payload ID: 16395
  Gene Symbol: SON
  Gene Name: SON DNA binding protein
  ENST ID: ENST00000429093
  CDS Start-End: 1-279
gtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaagtgcctgtgccttcttgtaagatctcttggcccccgttcctcactcctcttgtgacctgtagccccaggaccttttggttgtcagctgctggttacagcaagtggttgggaggccctagtattagctctgcatgtggtgatcttgccatgggactggaagcctgagggaggatggctggagtggggtgggctgtggtgaaggggatgggatggagattaatctgtggaccaccatttaggccctagtggcctctggtgatccacaggctcaatttgagaaccactaatttcatgacaaaacagatatgtaagacctaaaatcaagggagagaatggacgcctcgtgctacgaagatgagtactggcagcatagcagtgctgaaactgggaggccgcgtggtctaatggattgggaaggtttctttatcctgttgtactcctgactccttgtgtaatcatg

SEQ ID NO: 184795 - DNA, 765 bp, Homo sapiens
  Payload ID: 16395
  Gene Symbol: SON
  Gene Name: SON DNA binding protein
  ENST ID: ENST00000457208
  CDS Start-End: 1-293
aacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaagggccaaatccttgtagctgtcttcttgccccggtcagtgccagccgtactattcacaacactgctgctaccgaggcctaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatg

SEQ ID NO: 184796 - DNA, 1151 bp, Homo sapiens
  Payload ID: 16395
  Gene Symbol: SON
  Gene Name: SON DNA binding protein
  ENST ID: ENST00000421541
  CDS Start-End: 1-1032
tctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaagggtatgtagcagttttttaaaaaaaattattatttaccatcagccaactcacaccaatgtaccagttttaatgtctaaataagaattttgctaactagatggttgagttgtaacatcctttaccttattttcaatgtcttattttaaatgaaagtgattcgaggcctgatcatttattcaataaatgtttattgtttacta

SEQ ID NO: 184797 - DNA, 4123 bp, Homo sapiens
  Payload ID: 16396
  Gene Symbol: SOS1
  Gene Name: son of sevenless homolog 1 (Drosophila)
  ENST ID: ENST00000395038
  CDS Start-End: 29-3985
ccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagac

SEQ ID NO: 184798 - DNA, 8314 bp, Homo sapiens
  Payload ID: 16396
  Gene Symbol: SOS1
  Gene Name: son of sevenless homolog 1 (Drosophila)
  Uniprot ID: Q07889
  ENST ID: ENST00000402219
  CDS Start-End: 42-4043
ccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagccc

SEQ ID NO: 184799 - DNA, 8517 bp, Homo sapiens
  Payload ID: 16396
  Gene Symbol: SOS1
  Gene Name: son of sevenless homolog 1 (Drosophila)
  Uniprot ID: Q07889
  ENST ID: ENST00000426016
  CDS Start-End: 88-4089
agtagcgagcaggttcagttcgctagtaggaagctccagcgctacaccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagtttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctattttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaactaatcatgatagacagtccagaatctccctggactttatactgggccagcctcattgtccctaagatttctctttttatgtctcatggattacttctctttttaattgccccaggcacattccaaatgagaacctggtaaaagtcacattggacccccttcagtatgtcttcggctaatgtgttagccttcaataaggtgataaccccttttcaacctatctagtctataaagaggaaaaattcagatttggagttctaatcctatttctcccaaagggaactattcttctaccccatggttctaggagaccacttcactgtgcaacagttttacatgcattgtggatggaggatatttttattctgaactgttacatttaggtaaaaatattttctgcagtggtaactgattagaaaaatgccaattggatgcccttaggtggaggtgagaaaatggcatccttgccttcttctcaatatgaaacattaactagttgacaaatttatccttgtagtaatgaaaatctatttaatcagggaccagaaatggctgaggagataaatgcatcattacaaaattctgcttttgaatcctggacattacaagggggtaaatgcagcatgactttttgttaaccacattccaaaatgtggaacatttcttttagaaatgaaaatatttcaaggctgatgtattttaagactacacattatcaggaaacatacattgagagttcgcttaattaaaggttgttgggcatcaaattatgtttagtaggttactattctctaacaactcaaggatgctttaatggatctgaatttgacaaagagcatgccacactaatactacagtcaacaacagcccagagaacaattactatgtcagctggaggctatattatgattctaaattcttaaaggtttttttccctccataaatcaaaaattaccttatgtaaaccaaaaattagttggtatttatggtcatgatcttaattctcaagtttagcttaatcttgtatttcattgtttgtcttctaatatgacagcttaaattcagatttttaagtgactcagcaaaataggaggagtgtcccaatttattagtgttgtacatattgaagaaaacctttttgttccttcagatttagaaagaaacagtttaaccatttatttcttggtattctgctgctgtgaataggtttacttattcttttaacatatattgtgtgactacgcaagtataggtcctgttgtattgcattaatctttaccagtaactaaacatcacaaggttaatattggtttggctgaaagaattatgcagtaaagttatttataagggaacatgatgactttattcaatatttttcttctttgaaacatctcattactaacttttaagattatttcataatcccttatacatgagccaatgaaatattttgagctctacttaagaagcatgaagtctatattataaatctaaacaacaaaagcacttgtaacttgtttagtaaattccatgccttattttccatttttgacaccgtaaagtgcattttctgtcgactgtgagcaaatttcccttttgcctttaatgaaaatagtgcattaagtagccaattgctgcagaattataaagcaaattagctaacagtgggtcacattggactaccactcaaagaaacaagatgcataacagatgatggaaggtacatgtggtgtggcttagggagagcgcacctgtgccagatgcatgccactttcagtagctgccaaatgtgcctttaattaagaacatctctaatttttttcttcagatcaagtcagcatttggggtcgggatttgggcagggaactttggggtgcaaatatctggtgaaaccaccagagaatttgtttgtcaaagtgacatgtataattttagttgagacgtgtttgtgtatatatgtgtatttgcctttgtttagtagcacggttatttgctaaaataattgtcaaaaaattgctctgtcggtcggtctttgatgtaagaacaaagtgtggtctatacatctaatatggcctttgtacctaaccatgttcataggtaatctttgtactctgtgtgcagcagtatttggtttgcatttaaagtgaaaataacggctgttatttttctggcattactaagataaactgaaaaataataaagaaaaatgccttacatagcccacaagtgtattatttttgcatgtatttattttagagggcagtatttttgaaatcattagtgattctcatttagctcatatatgccatatagaaatattttgcatttttattgtggtctttctttggaggcacttttttcctgtatcaagttataaaa

SEQ ID NO: 184800 - DNA, 579 bp, Homo sapiens
  Payload ID: 16396
  Gene Symbol: SOS1
  Gene Name: son of sevenless homolog 1 (Drosophila)
  ENST ID: ENST00000451331
  CDS Start-End: 272-579
aagaagcctctgcgcctgcgccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaaca

SEQ ID NO: 184801 - DNA, 5498 bp, Homo sapiens
  Payload ID: 16397
  Gene Symbol: SOS2
  Gene Name: son of sevenless homolog 2 (Drosophila)
  Uniprot ID: Q07890
  ENST ID: ENST00000216373
  CDS Start-End: 276-4274
gggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaagacttttaaa

SEQ ID NO: 184802 - DNA, 3960 bp, Homo sapiens
  Payload ID: 16397
  Gene Symbol: SOS2
  Gene Name: son of sevenless homolog 2 (Drosophila)
  Uniprot ID: Q07890
  ENST ID: ENST00000543680
  CDS Start-End: 27-3926
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 184803 - DNA, 398 bp, Homo sapiens
  Payload ID: 16397
  Gene Symbol: SOS2
  Gene Name: son of sevenless homolog 2 (Drosophila)
  ENST ID: ENST00000556452
  CDS Start-End: 80-292
ggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaagaagtgtaaagcatggttctcttccattgtcctcttgatgtcctgttacagcatttatgggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccat

SEQ ID NO: 184804 - DNA, 2278 bp, Homo sapiens
  Payload ID: 16397
  Gene Symbol: SOS2
  Gene Name: son of sevenless homolog 2 (Drosophila)
  ENST ID: ENST00000555794
  CDS Start-End: 1-1259
tatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggtttggcttgaatattttttatatatatatatatacacatatatatacacacacacacacattttatgtgtcagttttcaatatatagttaacacaaaagctctcagcttttaattcaaatatagggaatatttttaacttcacagcagttaagttaaactaaaagagttctttctcagtgaagctattcttaaataccctgaagaaattcaaatatttaaatatcctatgtttgcatcacatatctctggcatgtgatatgttatgcttacgtatcaggatacctattttttattgtaagtaaaaattataaaatttcatgtgagctttcctgctgtcaaccttttttcacacttttttccttcatttccctttgcgatcatacagtaatcctggctttttttacaatttataatatttgtggaagttctagcccttttcccacttatctctcacaaaatatatagacatttgttagtttaattgcaataatttctaaaaatgtgtttgattgtagaagcttccagttaataaatactactgtgtgccggggattaccctaaatgctttatcttttttatctcattcttacaacatgattactattcctactttatatataaggaaattgaaacctagcaaggtgaagtaatttgagctaagttatgtaaagggagtggcaggacaagattcagactcatgtctgactttctttgcgtgtgtgtgtgtgtgtgtgtgtgtacgtaccactaagcattgaaaattggaagcgccttctcttagccctctttactgtccaagtaaccaaagtattatcttcctccttccattggaaaccaagttatcttattaattatatgtaatttaaattttttttctctctaaatttcaagtttccttgattactgttgaccaataaattgtaattttggaactgagtatattagttatttatttcccaggataattgccacaaacaaatgcagttttagaagaatgatagtgctcccagctatatgtctttcactaaaacttttaacgtcattctttgtataagaagatgagattatttatgtatcagcaataaataagtaattcttttctact

SEQ ID NO: 184805 - DNA, 4454 bp, Homo sapiens
  Payload ID: 16398
  Gene Symbol: SHH
  Gene Name: sonic hedgehog
  Uniprot ID: Q15465
  ENST ID: ENST00000297261
  CDS Start-End: 152-1540
gcgaggcagccagcgagggagagagcgagcgggcgagccggagcgaggaagggaaagcgcaagagagagcgcacacgcacacacccgccgcgcgcactcgcgcacggacccgcacggggacagctcggaagtcatcagttccatgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctgaagccggggggccgggggaggggcgcgggagggggcggggcggggcagcaacagcaacgcaaagcaaaaagacactcggaaaaggcgcacgaaccagactgagttataataagaataagaataataaagtaggacagtccaaagtagactctaaggaaacaaggaccccgggaagttttgttgttgtgcttagttgatatatattttttgaatttttttggttattgttttattttggttattttttcctcctctcctggctatttatttgtttggtatgaatagatgttttaaataatatgaaccggaccttcaagagccttaaatagtttgtttcttggataatttattatgatcatgtgaactgtactcacgggggaaagattattttgtgaggccaagcaacctgctcagagtctatttttctacatgtccctcgtcccggctgtcagaaagcaaacctctgtccccgccatccctcccttccatctcctgcttctcagcaagtgcaaactcaaacgtgcttcatgggggtccacaaattatatttttatacacagaattgtaaattagattttttgagagatcaatacttaactgaattacatttcatttttgaaatagtgtaaaatatgaaaatatattattttaatttaactagtttccgatgtaacagccatctcctctgttgtctttatggtttcatattccctttgtattcaccattttgccacattcttggaagccaagactgttacacacacaacatacacacacacttttctttttcttttcttttcttttttttttttttttttttttttggacaaactggaagaactgttatttttaacttcaaagaatttattagaaaataatattttttaaaagcgcacatagtgacgagcccacgaggatggagcctgcagtttgtacagagaaaacaaaggatgtttttgcattaataaattgagaaataacgctgtaaatttactaaaatgtatttttgaatattttgtaatagttttatagaaataaaatgtgccatgcacagaacgcttagtatctaataactaagaattcctgttgcagccctttttcttttagtttttggcttctttgtttgggaaacctagcgctgacaggagctcccaatattctatttagatgtgttgcttatactgtgaactcagactgactgacttaggtaaccaaagtaggcacacaaaccaacttgtttcttctcatggctggagaaacctcagctctgtttgtatttattgtgtgaagctctttctacactcccaaaggttgggagtgccattcgtggggactgtgctgtccccctcaccccaccccttaactagcaaagcctgatgtgtaagcccagaggaggtggcctggggatggccaccaacaaccttctcttaggactcctgtgtgtggttgctgggcagacccctggcctgaccctgtttgtgcttctctgatctgtagggaggaggctcattgctgctttctgaggtcctgttgtgtcccttccagaaagcatccttagaagagaggacccggtttgatcttctctgaagctcctatcctcttttcttgagggtccccttaaatctgagtggcaagcccacagtggcgagggccagtcgctggaatgtcggggctgctgttgaggtcctcaggctacactggttgtctgtgtcacatggcggtcgggcgtggactttgatccctgttgagagagcatgctgctgtgggcgctgggctggggaaggtccttccatgcttcatgctgccttggaggtttggccaagagggtctctgcccttggcggttgtcagggtcccaggtggaggactactcccagttctttggcttacggaaggtgtctgccatgctttgtgctttgggccgaatcgtctgagcaggctgggccttggaagagttgcgctgcatgagcttggggcctcccagcagctgcagcctgtgtagaaggtggtccaggcttagggaacaggagtgaacagacttcagccccacctggcaggggctggctcccgaggttgggcccagtccctgagggtctgctctgctacgggtctgcccttgagtggccttccgtggagggtgtgtgaccaggtggatggcgcagggcctctggagccctctcctcaggagcagtcctcagcctttttctgtaaaagacttttctttggtgttctaggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctggcaatgtggccgtgcagcccagacgatcagagagaagccaggcgttgaccaagccccaaggtgcctgaggccatggtgcaactctgctggtgactggggcaccttggagcagagcttcacccggatgggaaatcctcactcctgggtggcactccctcctggacaggcccggtggcagagtgtccgtgctgctgggtgctgtccccagccctcctggtccatcttcttaagatgcgtccactgctttatatttaaaattctctttttcacaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtatcacaatgtacttgaaactgttatctttgtgctctattgtttgaataattaaagaaattacagag

SEQ ID NO: 184806 - DNA, 677 bp, Homo sapiens
  Payload ID: 16398
  Gene Symbol: SHH
  Gene Name: sonic hedgehog
  ENST ID: ENST00000430104
  CDS Start-End: 171-677
tgaagcctggagtggggtcccgagccgctacactaaatagatttaatgtgcgctctggggccgccaggaaagacgctcaggcctcgctaggagcatcggctgtttcaggacctggagaaaggcccccagctctaccctgagaggacgtgctcctccacgctcctccgcaaatgctgtccctcttccccagcccagggcccggctcttcgaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtatcacaatgtac

SEQ ID NO: 184807 - DNA, 888 bp, Homo sapiens
  Payload ID: 16398
  Gene Symbol: SHH
  Gene Name: sonic hedgehog
  ENST ID: ENST00000441114
  CDS Start-End: 171-551
tgaagcctggagtggggtcccgagccgctacactaaatagatttaatgtgcgctctggggccgccaggaaagacgctcaggcctcgctaggagcatcggctgtttcaggacctggagaaaggcccccagctctaccctgagaggacgtgctcctccacgctcctccgcaaatgctgtccctcttccccagcccagggcccggctcttcgaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcaggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctggcaatgtggccgtgcagcccagacgatcagagagaagccaggcgttgaccaagccccaaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtatcacaatgtact

SEQ ID NO: 184808 - DNA, 807 bp, Homo sapiens
  Payload ID: 16398
  Gene Symbol: SHH
  Gene Name: sonic hedgehog
  ENST ID: ENST00000435425
  CDS Start-End: 171-542
tgaagcctggagtggggtcccgagccgctacactaaatagatttaatgtgcgctctggggccgccaggaaagacgctcaggcctcgctaggagcatcggctgtttcaggacctggagaaaggcccccagctctaccctgagaggacgtgctcctccacgctcctccgcaaatgctgtccctcttccccagcccagggcccggctcttcgaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagttcagtctgatttcaagtcagtcgaaagcgaaccagaagcaccgggcacagcagctcctctggctgtgtagacagacctggcaatgtggccgtgcagcccagacgatcagagagaagccaggcgttgaccaagccccaaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtat

SEQ ID NO: 184809 - DNA, 3517 bp, Homo sapiens
  Payload ID: 16399
  Gene Symbol: SORBS1
  Gene Name: sorbin and SH3 domain containing 1
  Uniprot ID: Q9BX66
  ENST ID: ENST00000277982
  CDS Start-End: 28-3483
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagagacaaagtcttgctctgtcatgtcacccaggctggagtgcagtggtacagtcatagctcactgcagcctcaaactcctagactcaagcaatcctcccacctcagcctcccaagtagctgggactgcagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattgg

SEQ ID NO: 184810 - DNA, 3015 bp, Homo sapiens
  Payload ID: 16399
  Gene Symbol: SORBS1
  Gene Name: sorbin and SH3 domain containing 1
  Uniprot ID: Q9BX66
  ENST ID: ENST00000354106
  CDS Start-End: 1-3015
atgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 184811 - DNA, 5858 bp, Homo sapiens
  Payload ID: 16399
  Gene Symbol: SORBS1
  Gene Name: sorbin and SH3 domain containing 1
  Uniprot ID: Q9BX66
  ENST ID: ENST00000306402
  CDS Start-End: 227-2572
agcgctgagtcccagaaaaacagagcggggccagctgcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggca

SEQ ID NO: 184812 - DNA, 3940 bp, Homo sapiens
  Payload ID: 16399
  Gene Symbol: SORBS1
  Gene Name: sorbin and SH3 domain containing 1
  Uniprot ID: Q9BX66
  ENST ID: ENST00000361941
  CDS Start-End: 28-3906
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagaggacaatccttacactcccacctaccagtttcctgcatctactcctagtcctaaatctgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattgg

SEQ ID NO: 184813 - DNA, 7279 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371227
  CDS Start-End: 191-3991
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagctttctcatcattcattgagagcaggaccagatctcacagaatctgaaaagagctatgtgcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggcata

SEQ ID NO: 184814 - DNA, 558 bp, Homo sapiens
  Payload ID: 16399
  Gene Symbol: SORBS1
  Gene Name: sorbin and SH3 domain containing 1
  ENST ID: ENST00000371228
  CDS Start-End: 1-558
agcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggagattcagaatcgccaagacattttataccagctgattacttggaatccacggaagaatttattcgaagacgtcatgatgataaagagatgagacctgccagagccaaatttgactttaaagctcagacactaaaggagc

SEQ ID NO: 184815 - DNA, 2436 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371239
  CDS Start-End: 1-2436
atgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 184816 - DNA, 2055 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371241
  CDS Start-End: 1-2055
atgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 184817 - DNA, 2779 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371245
  CDS Start-End: 28-2745
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagctttctcatcattcattgagagcaggaccagatctcacagaatctgaaaagagctatgtgcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattgg

SEQ ID NO: 184818 - DNA, 6931 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371246
  CDS Start-End: 191-3646
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagagacaaagtcttgctctgtcatgtcacccaggctggagtgcagtggtacagtcatagctcactgcagcctcaaactcctagactcaagcaatcctcccacctcagcctcccaagtagctgggactgcagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 184819 - DNA, 7354 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371247
  CDS Start-End: 191-4069
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagaggacaatccttacactcccacctaccagtttcctgcatctactcctagtcctaaatctgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 184820 - DNA, 5927 bp, Homo sapiens
  Payload ID: 16399
  Gene Symbol: SORBS1
  Gene Name: sorbin and SH3 domain containing 1
  Uniprot ID: Q9BX66
  ENST ID: ENST00000371249
  CDS Start-End: 191-2641
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggca

SEQ ID NO: 184821 - DNA, 575 bp, Homo sapiens
  Payload ID: 16399
  Gene Symbol: SORBS1
  Gene Name: sorbin and SH3 domain containing 1
  ENST ID: ENST00000486141
  CDS Start-End: 1-575
gcacagccggcacaggaaaaccaccccctgctcctcctcctgaccctcccaagctattctttgacatccgtaaagatgccgttaaccgtggcgagagtccttccctggggactcaggcttcgttcccagatgtgagaccacctgtgctaggcccccgggttacctctgatcccgaaaaccggaagagcaaagaatcttaccttttgcagccgagttatccagccaaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccgg

SEQ ID NO: 184822 - DNA, 720 bp, Homo sapiens
  Payload ID: 16399
  Gene Symbol: SORBS1
  Gene Name: sorbin and SH3 domain containing 1
  ENST ID: ENST00000492542
  CDS Start-End: 284-720
agtagagatgggttcctaatgtcatcgtttatttctcatggctgccagtaataaacacgaaagaagaactaaatatagtgagttatgtactcaccagctcatggtattatcctgaacttgccgcactgagaggaaattctgtagctctgtttagtagatggtacagagtaaaccccaggcagagagttttcatcttcttgtcatcccgcagaatatttctgatgactagagctctcagagcagttcagagccccagttgcagacgacttgtcctgccaccaccatgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttgg

SEQ ID NO: 184823 - DNA, 4374 bp, Homo sapiens
  Payload ID: 16399
  Gene Symbol: SORBS1
  Gene Name: sorbin and SH3 domain containing 1
  Uniprot ID: Q9BX66
  ENST ID: ENST00000607232
  CDS Start-End: 168-4052
ggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagtggatcgtaaaggtgggaatgctcacatgatttcttcatcttcagtccatagccgaacgtttaacactagcaatgcgttaggccctgtgtgtaagcacaagaagcccctgtcagctgcgaaggcctgcatttcggaaatccttccatccaaattcaaacccaggctctctgctcccagcgctcttttgcaggaacagaagagtatcctcttgccctcagagaaggctcaaagctgtgagaacctttgtgtttctggttctttaaatgattccaaaagaggcctccccctccaagtgggagggagcattgagaacctgctcatgcgctcccgacgggattatgacagcaagtcgagcagtaccatgagcctccaggagtacagcaccagcggcaggaggccctgtcctctctcaagaaaggctgggatgcagttcaccatgctttatcgggacatgcaccagatcaaccgatctggcctcttcctgggctccatctcctcctcctcgagtgtgcgggatcttgcctcccactttgaaaagagtagcctggcattgtccaggggtgagctgggccccagccaggagggctcggaacacatccccaagcacaccgtctcttcccgcatcaccgcttttgagcagctgattcagcggtcccgttccatgccatccctggacctgtccggaaggctgagcaagtctcccacacctgtgctgtcccggggcagcctgacctcagcccgctcggccgagtccctacttgagtcaaccaagctccatcccaaggagatggatgggatgaactccagtggggtctatgcttccccaacatgtagcaatatggcacaccatgccttgagcttcaggggccttgtgccttctgagcctctctccacctgctctgatgacgtggaccgctgttcaaatatctccactgacagcagagaaggcagtggcggcagtgttcatggagatttccccaaacatcgcctcaacaagtgcaagggcacctgcccggcctcatacacccgcttcaccaccatccggaagcatgagcagcagcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagcc

SEQ ID NO: 184824 - DNA, 1847 bp, Homo sapiens
  Payload ID: 16399
  Gene Symbol: SORBS1
  Gene Name: sorbin and SH3 domain containing 1
  ENST ID: ENST00000634504
  CDS Start-End: 1-1523
ctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccag

SEQ ID NO: 184825 - DNA, 5996 bp, Homo sapiens
  Payload ID: 16400
  Gene Symbol: SORBS2
  Gene Name: sorbin and SH3 domain containing 2
  Uniprot ID: O94875
  ENST ID: ENST00000284776
  CDS Start-End: 511-3813
tccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 184826 - DNA, 2011 bp, Homo sapiens
  Payload ID: 16400
  Gene Symbol: SORBS2
  Gene Name: sorbin and SH3 domain containing 2
  ENST ID: ENST00000319454
  CDS Start-End: 103-2011
taaaaggccactgactcctacttcctctgtatagagcaactgttgaactcagctgcctgtaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgt

SEQ ID NO: 184827 - DNA, 2824 bp, Homo sapiens
  Payload ID: 16400
  Gene Symbol: SORBS2
  Gene Name: sorbin and SH3 domain containing 2
  Uniprot ID: O94875
  ENST ID: ENST00000319471
  CDS Start-End: 307-2502
cgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 184828 - DNA, 4622 bp, Homo sapiens
  Payload ID: 16400
  Gene Symbol: SORBS2
  Gene Name: sorbin and SH3 domain containing 2
  Uniprot ID: O94875
  ENST ID: ENST00000355634
  CDS Start-End: 715-4317
ttttattacgtctctccttgtggattacgtagaactttggaaaattaaacattagacatcttcatagaaaatcatgtcactgatttttaaagccagctcaatttaacctgccactgattccctaaccagctcttctctgactgtatcccgagggaaaatgtattgaacgcagcagaaggttaaggcagaggagttcggctagaccgggtagcagccaatcagatggggagggtccaaggatctgatgcctccaggcgagcagcgccaagctgagctggttagtctccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagccaaccaatttgttggaaaatcagtcaaaatctaattttgatgttctgcaagttccctgggggccatgaagcacctgacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggc

SEQ ID NO: 184829 - DNA, 842 bp, Homo sapiens
  Payload ID: 16400
  Gene Symbol: SORBS2
  Gene Name: sorbin and SH3 domain containing 2
  ENST ID: ENST00000393523
  CDS Start-End: 815-842
ggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccc

SEQ ID NO: 184830 - DNA, 3043 bp, Homo sapiens
  Payload ID: 16400
  Gene Symbol: SORBS2
  Gene Name: sorbin and SH3 domain containing 2
  Uniprot ID: O94875
  ENST ID: ENST00000393528
  CDS Start-End: 739-2739
cattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaactgatcgcataaatccagatgacatagatttagaaaatgagccctggtataaattcttttcagaactggagtttggacgcccgcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgagg

SEQ ID NO: 184831 - DNA, 543 bp, Homo sapiens
  Payload ID: 16400
  Gene Symbol: SORBS2
  Gene Name: sorbin and SH3 domain containing 2
  ENST ID: ENST00000456060
  CDS Start-End: 498-543
agatagaatatgactggtgatagagtcctgaaaaagaagaaaagcctgggggttctgcagaagatttacgttgttcatggcattaatcatggtagattcccagaggaggtgaaatgttatggacgggtggaatgtgatccattttactgaggaagtaaaactattcttgccttgaagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaaggaaaactgaagactttaataacaaactctccaaggtgaaaatgaacacagatagcggtgggtgtgctcgcaaacgtgccgccatgt

SEQ ID NO: 184832 - DNA, 871 bp, Homo sapiens
  Payload ID: 16400
  Gene Symbol: SORBS2
  Gene Name: sorbin and SH3 domain containing 2
  ENST ID: ENST00000438278
  CDS Start-End: 1-871
ctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgatttt

SEQ ID NO: 184833 - DNA, 534 bp, Homo sapiens
  Payload ID: 16400
  Gene Symbol: SORBS2
  Gene Name: sorbin and SH3 domain containing 2
  ENST ID: ENST00000429056
  CDS Start-End: 323-534
ctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactca

SEQ ID NO: 184834 - DNA, 759 bp, Homo sapiens
  Payload ID: 16400
  Gene Symbol: SORBS2
  Gene Name: sorbin and SH3 domain containing 2
  ENST ID: ENST00000445625
  CDS Start-End: 1-759
agcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaag

SEQ ID NO: 184835 - DNA, 574 bp, Homo sapiens
  Payload ID: 16400
  Gene Symbol: SORBS2
  Gene Name: sorbin and SH3 domain containing 2
  ENST ID: ENST00000421420
  CDS Start-End: 29-574
ctttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacacc

SEQ ID NO: 184836 - DNA, 3381 bp, Homo sapiens
  Payload ID: 16400
  Gene Symbol: SORBS2
  Gene Name: sorbin and SH3 domain containing 2
  Uniprot ID: O94875
  ENST ID: ENST00000437304
  CDS Start-End: 585-3059
agctttcaaaaatagcatagttgatgaaactggaaatttaggtgcgggctcttttaagaaatcatttgtcttcagtcttaagaatagactgacaacagatactgctaccagagggctctcaactatttcttaagaccccctaggaaatatcagaagaaaagcctccttctcaataaagcataagtaggacatctcgttttcagtgaatcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcaaaaggttttagaagcgttcgaccaaacctacaagataaaagatcaccaactcaggcaccccctccaccagaaagaaaagagagctttcatagctctttgataaccagtcacacaaagggtgtcattttagaccagttagtaactaacacacaaattccctccagtacagagtactttgctaacaaaaaacctcttcagggaactatgtattccaatgaagattcgagacagacaattgtatattctgaagaatctaacacaaccatgtcatatacacaaaaaatcactaatccactaccagcagcttccagcacggatcctgcaccattcgctaacatcaacaccccagttctacaagaggactacaggcaagattctcaaactcggaggatttctaccttgaaactaacccataaccaggatctaggaagtagcagccccattagtactccacagttctccaaatctgtcgaagtaccgtcatttctcaaaaggccccgctcactgacccctaatccagtgcctgagacacacacagcatctctttccattcagatagctcccctttcaggacaggatcttgaaagccacaaacagctacctgagctttctccagagactgcaaagatacctcttcagcaagagagacaaaaatctgcagttgcagcggcctctcagtcctcagactgcagagtgagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaa

SEQ ID NO: 184837 - DNA, 611 bp, Homo sapiens
  Payload ID: 16400
  Gene Symbol: SORBS2
  Gene Name: sorbin and SH3 domain containing 2
  ENST ID: ENST00000444781
  CDS Start-End: 312-611
gtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatat

SEQ ID NO: 184838 - DNA, 3049 bp, Homo sapiens
  Payload ID: 16400
  Gene Symbol: SORBS2
  Gene Name: sorbin and SH3 domain containing 2
  Uniprot ID: O94875
  ENST ID: ENST00000449407
  CDS Start-End: 794-2728
gagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaa

SEQ ID NO: 184839 - DNA, 5529 bp, Homo sapiens
  Payload ID: 16400
  Gene Symbol: SORBS2
  Gene Name: sorbin and SH3 domain containing 2
  Uniprot ID: O94875
  ENST ID: ENST00000418609
  CDS Start-End: 332-3346
gatttgggagttgggaggtgagatgattggagtgaagagagttaatgtcatggaaaggaaaagctgtctgaagaaaaatacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 184840 - DNA, 575 bp, Homo sapiens
  Payload ID: 16400
  Gene Symbol: SORBS2
  Gene Name: sorbin and SH3 domain containing 2
  ENST ID: ENST00000445115
  CDS Start-End: 372-575
attctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaa

SEQ ID NO: 184841 - DNA, 573 bp, Homo sapiens
  Payload ID: 16400
  Gene Symbol: SORBS2
  Gene Name: sorbin and SH3 domain containing 2
  ENST ID: ENST00000457247
  CDS Start-End: 396-573
agaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggtaaacacggtgttccagaatacagcaggagcatctgggcatttttgtggctggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagagg

SEQ ID NO: 184842 - DNA, 546 bp, Homo sapiens
  Payload ID: 16400
  Gene Symbol: SORBS2
  Gene Name: sorbin and SH3 domain containing 2
  ENST ID: ENST00000445343
  CDS Start-End: 246-546
agcacaacaatcatttgttgagagcctactcaagactctgtacttgtccgtgacagtcactgggagcatagcctttctccaatgacatcgccctgaacatccactctaaaaatgcagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacga

SEQ ID NO: 184843 - DNA, 873 bp, Homo sapiens
  Payload ID: 16400
  Gene Symbol: SORBS2
  Gene Name: sorbin and SH3 domain containing 2
  ENST ID: ENST00000451974
  CDS Start-End: 1-873
caaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccacctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaa

SEQ ID NO: 184844 - DNA, 525 bp, Homo sapiens
  Payload ID: 16400
  Gene Symbol: SORBS2
  Gene Name: sorbin and SH3 domain containing 2
  ENST ID: ENST00000428330
  CDS Start-End: 271-525
ctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagcttggaaatcagaacttacctgccagtgtgttggaggtaaatgcttcacagacacacagacaaaccacaccagaagcttctcctccgtgccct

SEQ ID NO: 184845 - DNA, 590 bp, Homo sapiens
  Payload ID: 16400
  Gene Symbol: SORBS2
  Gene Name: sorbin and SH3 domain containing 2
  ENST ID: ENST00000414724
  CDS Start-End: 243-590
tttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatcc

SEQ ID NO: 184846 - DNA, 582 bp, Homo sapiens
  Payload ID: 16400
  Gene Symbol: SORBS2
  Gene Name: sorbin and SH3 domain containing 2
  ENST ID: ENST00000451701
  CDS Start-End: 229-582
gattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagcttggaaatcagaacttacctgccagtgtgttggaggtaaatgcttcacagacacacagacaaaccacaccagaagcttctcctccgtgccctccttccgtggtacctttgaaccgagccactttctcaccaggcagtggcaccagctcagcatcactcagccttccg

SEQ ID NO: 184847 - DNA, 594 bp, Homo sapiens
  Payload ID: 16400
  Gene Symbol: SORBS2
  Gene Name: sorbin and SH3 domain containing 2
  ENST ID: ENST00000451958
  CDS Start-End: 267-594
agattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatg

SEQ ID NO: 184848 - DNA, 553 bp, Homo sapiens
  Payload ID: 16400
  Gene Symbol: SORBS2
  Gene Name: sorbin and SH3 domain containing 2
  ENST ID: ENST00000457934
  CDS Start-End: 266-553
aaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggt

SEQ ID NO: 184849 - DNA, 499 bp, Homo sapiens
  Payload ID: 16400
  Gene Symbol: SORBS2
  Gene Name: sorbin and SH3 domain containing 2
  ENST ID: ENST00000430503
  CDS Start-End: 143-499
gactcctacttcctctgtatagagcaactgttgaactcagctgcctagcgagaataggacagactcgtataccattctgatctgggtgcatttcttcagaaggaaaactgaagactttaataacaaactctccaaggtgaaaatgaacacagggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattaccca

SEQ ID NO: 184850 - DNA, 562 bp, Homo sapiens
  Payload ID: 16400
  Gene Symbol: SORBS2
  Gene Name: sorbin and SH3 domain containing 2
  ENST ID: ENST00000431902
  CDS Start-End: 322-562
accacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcag

SEQ ID NO: 184851 - DNA, 572 bp, Homo sapiens
  Payload ID: 16400
  Gene Symbol: SORBS2
  Gene Name: sorbin and SH3 domain containing 2
  ENST ID: ENST00000421639
  CDS Start-End: 348-572
agttgtaaagcaaacagtgtaggtattggaagccgttcacacctcctttccgagtatctgcatgccttgctggcccagagcacaagacccccattgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcaaaaggttttagaagcgttcgaccaaacctacaagataaaagatcaccaactcagagccagataacagtgaatggaaactcaggaggtgccgtg

SEQ ID NO: 184852 - DNA, 582 bp, Homo sapiens
  Payload ID: 16400
  Gene Symbol: SORBS2
  Gene Name: sorbin and SH3 domain containing 2
  ENST ID: ENST00000432655
  CDS Start-End: 320-582
gtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagat

SEQ ID NO: 184853 - DNA, 835 bp, Homo sapiens
  Payload ID: 16400
  Gene Symbol: SORBS2
  Gene Name: sorbin and SH3 domain containing 2
  ENST ID: ENST00000419063
  CDS Start-End: 497-835
gtttttgtcttgggaaggcaagctttccctgcaatattatctcagcagctccctagctgcttaccctgaaaacgagggatccaaacggagggtgttgcactctgctaacgctggtcctgtgcgtggctgtggcatatgagcggcaggtctgaaaaagcaggtgtgtgctgggacgggcactggactggaacgcaggcggacgctctcgggtttacctgcttcctgttaacagattgtgggctcccagggcatatgtctgcacgctgaggccgaggcggagaaggggcttcctgagcgtcccagtacactgacagagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatat

SEQ ID NO: 184854 - DNA, 565 bp, Homo sapiens
  Payload ID: 16400
  Gene Symbol: SORBS2
  Gene Name: sorbin and SH3 domain containing 2
  ENST ID: ENST00000439914
  CDS Start-End: 287-565
aacagattgtgggctcccagggcatatgtctgcacgctgaggccgaggcggagaaggggcttcctgagcgtcccagtacactgacagagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccgg

SEQ ID NO: 184855 - DNA, 4356 bp, Homo sapiens
  Payload ID: 16400
  Gene Symbol: SORBS2
  Gene Name: sorbin and SH3 domain containing 2
  Uniprot ID: O94875
  ENST ID: ENST00000448662
  CDS Start-End: 188-2173
aagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccacctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggcaaaaaaaaaaaaaaaaagtgtctccaggaggctgtccagcctcgtggctccatttcaacatctccccccaggcgatgttctcccccaagacgaccagaaaattgtttattggggaatgctgtggtttgcattttcatattcttcgcttggcagtgtgtattcttttcacaagtttgcctagtgtcttggtttacacaatatgacaactgtaactgtactttagctattgtttgcctgcacatacatgttgtaatatgcacagtgattacaacctttaaagcaagaggaggcgagttaatttggatgagtgtgattttgctgattgaatgtgagttttcaaataggagtctttttctgcaatttgtttgcattttttagaagtgcaaacagtaagtaaataaaagccttcggtaataatcatgacaatacaagaggctgagctaggctacaggggaaaactattgtgttgtaaagttgcatcgctattttatattaaaatgtaatgatcagcatcatgaacaatgagctcttagtgttttatttatctgaaaaaatgtaagtaaaagcagtgttagtgagaggtgcaaagaattattctaacagacacctgaaagtatctgtaagcaatactagtaggtaagatttcactgtgtgtacacatacacatttgagattgtatgagaacatataatccatatgatatgttgtacattttatggaaatgtaatagaatctcacacattattttatagaaatagagtacagaagcatcacaagtattaaagttggttttagcaaggattaggattactacaattatttttactataataattatttttcttctatggaactcagaatcctggctacatttgaggacaggaatatgttgagcctgattttcctggtgtgtgtaaaatatttcctaggaataaattaggcactttttagaagcaatgttaaatcattcaggttttattttctgccctgaagcagaaatttaaaaaatgatattgggacctggaaggtttaatatggttcacagtgcctgaattacacctgctccgaaaactagctttgtatttcttatgactttgcataagaactgttcatctttggatcttgagcaccttacagataaaactttttatggcatctctttcatggacagtgatattgatcttttcacaatgtacgtagcctctagaattttgtacatatgtttgctctttttttgtacagactagttgttgagaaaacaggggcgtttcctaatttggtctttatcctgcgacaacactttcagcagactagcctctccttatctcacagatcacaagcacccctagatagtgtgattctgtcagatagcatttatgcaaaaatctatgaagttaaaagatcgtagaagccaaatgaaatgtacatatctactgactgatgacaagggaatttcattaggaagaaggtaaagaaacatcgttgagtagcctaccttgatttctgtcaagttcataaccagcttcatattttaaaggcttcaggtttgaaattaagtcaactgcatgcagctttgctgataaatgaataattctctttgatgccatttatgagaaaagacttcaatatctgttgcctgtcatatttaagaaaaattactgtttctactctctgtatctgattttaaaagaaaaaactattcatacctggcttccaggtaattgactttgaattcttacaagcaaaggtcattgtgtttttcttgaatagacatctaataaattttgcttggaagtatacttcagtttttcttcttgacatttatctttataaaaattgtgtattttattccaacttgttaaactaagagaaaatgca

SEQ ID NO: 184856 - DNA, 572 bp, Homo sapiens
  Payload ID: 16400
  Gene Symbol: SORBS2
  Gene Name: sorbin and SH3 domain containing 2
  ENST ID: ENST00000420158
  CDS Start-End: 252-572
attgtgctcccccggctcagaatccaaggaaagaaaggaagcgaagcctctgcattgagttctaggacagctgagacacttggattggacttaatcttaaacctctggagttcaagaccttttaaaaagggctaaataaacaatctctacatgtaaaaggccactgactcctacttcctctgtatagagcaactgttgaactcagctgcctgaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccg

SEQ ID NO: 184857 - DNA, 760 bp, Homo sapiens
  Payload ID: 16400
  Gene Symbol: SORBS2
  Gene Name: sorbin and SH3 domain containing 2
  ENST ID: ENST00000444771
  CDS Start-End: 494-760
tggcgatctgggcaaggcattttcatccctttgcagacaaccccggctgctgttaatgctgaaaatagctcaaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacg

SEQ ID NO: 184858 - DNA, 574 bp, Homo sapiens
  Payload ID: 16400
  Gene Symbol: SORBS2
  Gene Name: sorbin and SH3 domain containing 2
  ENST ID: ENST00000456596
  CDS Start-End: 408-574
tttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagagcgagaataggacagactcgtataccattctgatctgggtgcatttcttcagaagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccg

SEQ ID NO: 184859 - DNA, 571 bp, Homo sapiens
  Payload ID: 16400
  Gene Symbol: SORBS2
  Gene Name: sorbin and SH3 domain containing 2
  ENST ID: ENST00000452351
  CDS Start-End: 359-571
agcagggatgaatgtcctgacagcgtgtgtccactgtgcatgtgcttccacttgtcagcatgggcgaagcccaagtatgatgtgtagacaagaccaccgcttctctctgctccattcctgcacaagccacacacagcagacttgtatttctgtcaagggctccggttttccatcatctattttttatagcactgatactcaaccagttgcagcaaatgaagggtattatttctggtttgagggcatcgcgatgctgatttgccattcctaggaagcaaactcaccgtgttgggctctcattttaccatgggagacccggctccacaaaaccggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcag

SEQ ID NO: 184860 - DNA, 487 bp, Homo sapiens
  Payload ID: 16400
  Gene Symbol: SORBS2
  Gene Name: sorbin and SH3 domain containing 2
  ENST ID: ENST00000435480
  CDS Start-End: 248-487
agaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactca

SEQ ID NO: 184861 - DNA, 626 bp, Homo sapiens
  Payload ID: 16400
  Gene Symbol: SORBS2
  Gene Name: sorbin and SH3 domain containing 2
  ENST ID: ENST00000415274
  CDS Start-End: 387-626
gatgcctccaggcgagcagcgccaagctgagctggttagtctccttttattgtggatgaacaccacgtacatgccgtaaatgctccctaggctggctgcggctacaaggcagacccgggagctgagaatagaggaatacctgcccaagcaactcattctgcacagcagccgacaagacagcgattttcctgtgctggaatgtgcccatccaaagacacttggattggacttaatcttaaacctctggagttcaagaccttttaaaaagggctaaataaacaatctctacatgtaaaaggccactgactcctacttcctctgtatagagcaactgttgaactcagctgcctgtagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactca

SEQ ID NO: 184862 - DNA, 629 bp, Homo sapiens
  Payload ID: 16400
  Gene Symbol: SORBS2
  Gene Name: sorbin and SH3 domain containing 2
  ENST ID: ENST00000425679
  CDS Start-End: 266-629
aaatgctctcagaacagtagcaccacccagcagctgggattctttccctctctcatttgcctctctcttgctttttttccttcagacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatcc

SEQ ID NO: 184863 - DNA, 567 bp, Homo sapiens
  Payload ID: 16400
  Gene Symbol: SORBS2
  Gene Name: sorbin and SH3 domain containing 2
  ENST ID: ENST00000450341
  CDS Start-End: 349-567
gtaaaaggccactgactcctacttcctctgtatagagcaactgttgaactcagctgcctgtagagcgagaataggacagactcgtataccattctgatctgggtgcatttcttcagaaggtacgctgtcctcacgggaaaccgcccgccactgcctgggtttggggctgatgaggccaggaagaaacttaatgcgtgcactctaacaaaaagatttcccaggcgtgattctcagtcaccagactcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattaccca

SEQ ID NO: 184864 - DNA, 549 bp, Homo sapiens
  Payload ID: 16400
  Gene Symbol: SORBS2
  Gene Name: sorbin and SH3 domain containing 2
  ENST ID: ENST00000439049
  CDS Start-End: 188-549
aagcagataggtttcagagataaagagtgaaaccaaaaacaccgcacacctcatccaaatctgcgctcatacttgcagcaaatgtttgctgtcagttgcttcataataacagcacagaccccgaattgcaggaggaattgcctggtagaaaactgaagactttaataacaaactctccaaggtgaaaatgaacacagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctat

SEQ ID NO: 184865 - DNA, 3459 bp, Homo sapiens
  Payload ID: 16401
  Gene Symbol: SORBS3
  Gene Name: sorbin and SH3 domain containing 3
  Uniprot ID: O60504
  ENST ID: ENST00000240123
  CDS Start-End: 384-2399
cgcgcgcgccccgacggacggagagcactcgcacgtccctcctctccggcccagccccggcccgcagtccagatccgagacccaaactccgcccgccccgccgcgcgactctcacggtccggcctccggcgcgcgccccttcggcctccctcttcctgcgccggcgcccggcccggcccggcccgtcctgacccggtcacgagggccgcgacggcccgcgcttctccttgcccttcctcctcgagcgcccgcgccaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaagggaccttgtctctgcggccttttccttggggtaggggatgcctcctcctgtctaggagatgggaattccttctgtggagggctgtgctgggagacaggtgggacaggtgtgtgtgtaagaggaggaggatggaaaaacaccattattacctccaaagatctctgcccttgggtgtcaggcaggttgcggcagcccccacaattgggcagctgtgtggcaagaagtgctgggagaatgaacagtgccaggccctggtagcagggagacaccagagatgggggactgaatgtggcctt

SEQ ID NO: 184866 - DNA, 456 bp, Homo sapiens
  Payload ID: 16401
  Gene Symbol: SORBS3
  Gene Name: sorbin and SH3 domain containing 3
  ENST ID: ENST00000520563
  CDS Start-End: 1-456
taatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagaagaagctgggaccactctgaagagttacctagaagcaccttcaactacagacctggagcattctccactgtgctgcagccctcaaatcaggtgctcagacgccgggaaaaagta

SEQ ID NO: 184867 - DNA, 885 bp, Homo sapiens
  Payload ID: 16401
  Gene Symbol: SORBS3
  Gene Name: sorbin and SH3 domain containing 3
  ENST ID: ENST00000517962
  CDS Start-End: 1-560
agaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcc

SEQ ID NO: 184868 - DNA, 680 bp, Homo sapiens
  Payload ID: 16401
  Gene Symbol: SORBS3
  Gene Name: sorbin and SH3 domain containing 3
  ENST ID: ENST00000523348
  CDS Start-End: 1-680
gcggtcctcgtccccacctgcagggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggacccc

SEQ ID NO: 184869 - DNA, 601 bp, Homo sapiens
  Payload ID: 16401
  Gene Symbol: SORBS3
  Gene Name: sorbin and SH3 domain containing 3
  ENST ID: ENST00000522721
  CDS Start-End: 320-601
gtgtccgggagggaccgcagcgccactctctgcggggcgccgttcccgcgccaccgagggcagctaactcctagcagaggaccggggtcgcggccgccgggggcgcagcgcggttagggcggccccgccacggcccaggcactcccgctgggccctgccgggcctcacccttccccgcgcagcgactcgggaagtaggacatcctgtggagagcccaggacccgggagacgccctgggaggagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtg

SEQ ID NO: 184870 - DNA, 1228 bp, Homo sapiens
  Payload ID: 16401
  Gene Symbol: SORBS3
  Gene Name: sorbin and SH3 domain containing 3
  ENST ID: ENST00000517500
  CDS Start-End: 152-1138
cttcctcctcgagcgcccgcgccaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagc

SEQ ID NO: 184871 - DNA, 2028 bp, Homo sapiens
  Payload ID: 16401
  Gene Symbol: SORBS3
  Gene Name: sorbin and SH3 domain containing 3
  Uniprot ID: O60504
  ENST ID: ENST00000523965
  CDS Start-End: 272-1261
ccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggga

SEQ ID NO: 184872 - DNA, 670 bp, Homo sapiens
  Payload ID: 16401
  Gene Symbol: SORBS3
  Gene Name: sorbin and SH3 domain containing 3
  ENST ID: ENST00000523900
  CDS Start-End: 149-670
gagctggccgagctgagcgccgagctggacaaggacctgcgggcaattgagacccgactgccgtcccccaagcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccc

SEQ ID NO: 184873 - DNA, 4909 bp, Homo sapiens
  Payload ID: 16402
  Gene Symbol: SORD
  Gene Name: sorbitol dehydrogenase
  Uniprot ID: Q00796
  ENST ID: ENST00000267814
  CDS Start-End: 181-1254
ctccacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaacctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgactcatgctgctgtttatggtcctgtttagtggggaatggactcaggttacccatttcccagagggaaggatcccaggatttttgaaggttacatattttctgtaccaaatataatttcattgacatgaattatctctaatcctcatgacaagccacatacacaatcattttgtagataaagaagatataaatgccagaggagaccttaagattgtcttacaacacaacccttcagttaacgagagaggaaattgaggctcagattggggaagtgacttggcaaatcacacagtgggttagtcaatggcccaggattagacagaacccaggaatcctgacatcaaatcctttacaacatgctgcctctcataggcctgaggtgtccagtcctagaggacaaatgatgctccccatgccaccacccccaccaagcagctcctactgatgagaagatgcactaagcagtcttggtggaaacatcttcctcacgccctgtgccccctttcaggtgcccagagaaggagctccagtgtctgcttcagccagggctttaagagagaaggaagctgggagtgaggggcagaggctctaccagagaatgtctgctggtgtcttggaggcacttcctgcagcctatgcatgcctcgtgaagccatttcactgctgccccttcatcctcctcctccctgagccctaggtagaagtcagtgtgtggaggaggccacccagagatgaccctgaccaggccccaccgcctgtagccagacccagcctctgtcccagctggctgctaatttctgagcatttcttccctgttatttggcctctgtaccttgaacctaggttgacatcatgagcagaggacagttcttaggaaaggcaaatatcccataaatcctatttgcctctctttctcctaacctctggctccaccaactccccaacaggcctcctgcacacacaataggagtcaggagggaggaggcaggactgtgctacacaagggagactgggtggggaagatgtcagagaaccagtgactgagtgcagaggtgacttcacaccagcatctgctgtagccagaggtgggctgcaagagggaattagaggagccaacatgtcctctttctcctttagggtccatggagcagtccgctgcttccaggttgcctgtggggtccttcccagctctccgccctgacacgtcttcactccctagcactcgtggagctgactgggtggggacctcagtgttgactgaaagcgtgaatcaagtgccaggcactggtgacagagcacacagaggctgctgggcctcccaaggtcggggagcttgtggggaattcacattcttggttccgggactgattcactgagtcaatcaatattgattgagcacttagttggttgtggtggtggtaggaatgaattcctgggcttcctgcagcccctttccatgaatctatacatatcaaacatgtgcatgcatttgtaaacattaatgggagtgtactttacttttttcattttactcataaacagacgaggactttaaaaaaatcacaattattaaataattcccattactatacctgacaaaactaataataatttcataatagctaataccccgtcaatccatgccatattttccctcatctaaaaaacagaaaaaattacttttttttcccccaaagacagggtcttgatcagagctcactgcaatatcaaactcctgggttcaagtgatcctcctgtctcagcctctggagtagctgggattataggcatgcaccaccatgcctggctactttttgtagagaaaaaaatttaaaaaggtctcactatgtggcccagagtgttcttgaattcctggcctcaagcaatcttcctgcctcagtttcccaaagcactgagattacaggcatgagccaccatgcccagccaaaactttacttttttacacttgcttttctggaatcaggatctaaacatattgcatgcggttgatatattaagcctgttttattttttattttttcttctttcttaagcctctttattatagttccccctacattttggttcacatgccactgttatgttgaagaaactgggtcctttgtcttctggataccgttttacaaacatacttgttttcatttaataaatggctaaatttctttctatgtcaataattatacacatcattattttaaatcaccacatcccattgtgtggatagactatcatttataaagcaaattgcagtattttgagtgtttggatagtttacagagttttgctctaataataaagttgcaatgacaacccttgttgcata

SEQ ID NO: 184874 - DNA, 1502 bp, Homo sapiens
  Payload ID: 16402
  Gene Symbol: SORD
  Gene Name: sorbitol dehydrogenase
  ENST ID: ENST00000559230
  CDS Start-End: 90-443
agtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggttggaaaacaaagaaccagaccaaagagcgggcagactctgctcccaccctcggacatggtgccatctttgttttcctctccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaacctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggca

SEQ ID NO: 184875 - DNA, 1395 bp, Homo sapiens
  Payload ID: 16402
  Gene Symbol: SORD
  Gene Name: sorbitol dehydrogenase
  ENST ID: ENST00000558580
  CDS Start-End: 107-1117
tgagaccaagaacccaccaattccggacacaaagagaggagtatatatgtgattaagatatgtatttctgacttgaagtgaaatattctggaaaactcacacaactatggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaacctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttc

SEQ ID NO: 184876 - DNA, 1553 bp, Homo sapiens
  Payload ID: 16402
  Gene Symbol: SORD
  Gene Name: sorbitol dehydrogenase
  Uniprot ID: Q00796
  ENST ID: ENST00000558789
  CDS Start-End: 104-406
cccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacacctaggaacagataagctgccagtgcccgactcgcccctcagcgacccaccagccacttatgggaagttggcaggaagttggaggtggtgggagggagtgtcattgacagatcaaagtatgaggaaacgaagggaaaataacaacttccaggttccaagccctactgtacgccaggttctctgctgtactttataaacatgaggcctaatctgcacaatagccctgaaaaccagttaccattttatgctgagggatttgtggtttgtttgaggcaagccaagtcaggcccaggcccagccctgccaggccccagtgcctgagttgccccgctgcttaggagaggaagggaaggagggcacgaacaaccatgctagggtggggggacagggccagggctggagagggtagcaggcagccgccaccacaggggactcctgtccctgcctcccagacagcctccccaggtagcgtgggcttcctccttccttctgaggctcacagcaggagggcactttgcatcacatgagacattctagggaaggctgacccaccaagctgagtagcagagctgcctagacctcctcctactaagttgcccagcggccttgggagctgaggaagcagtgggggagagggaggagcgggtgccaccttggcagtgtcgtgagtttcagctggagtcggccagccctctgcttcactgtcataggcagtggtcgccatgtgggaaggggcaaaaagaagccgaagctcagagaggaacaatggatctgtgtgtgattgatctacccatggtatgtcttgggtacctaccatgtgcca

SEQ ID NO: 184877 - DNA, 2010 bp, Homo sapiens
  Payload ID: 16403
  Gene Symbol: SRI
  Gene Name: sorcin
  Uniprot ID: P30626
  ENST ID: ENST00000265729
  CDS Start-End: 54-650
gggcggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaa

SEQ ID NO: 184878 - DNA, 653 bp, Homo sapiens
  Payload ID: 16403
  Gene Symbol: SRI
  Gene Name: sorcin
  Uniprot ID: P30626
  ENST ID: ENST00000394641
  CDS Start-End: 80-631
gattcttctatttggccactctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaat

SEQ ID NO: 184879 - DNA, 1418 bp, Homo sapiens
  Payload ID: 16403
  Gene Symbol: SRI
  Gene Name: sorcin
  Uniprot ID: P30626
  ENST ID: ENST00000431660
  CDS Start-End: 63-605
actctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatgtaagtcttagaaattaagagatacagtagatgaaaaggatgtacaccagatgggtatccctttgaaattagctgttaagaatatcttaaggttaaggatgccagagacataagggattcaaaagttagaaagagttatcatccagaatttattaatttcatttattagtcttaactatagtgagaccatgatttgatttgcattcagagacctgggttcaagacccagcttgttgtatttattagctgggtcacttaagcaggtttcttaattgctgtgacactatatgaataaagaagatatagtagtaatgcctttttcactgagccattgtaagatttctattagaaatgcccttgaaaaacactatgcagatatactatctgcttttgtcttctgtaaacaaatcatgtcagtcactgagaatagataacagctcaatagttttgcatacctatgttcttcattgagggcataaggcaggcaacaacttaaatcacaattttttttttttttttgagatggagtctcgctctgttgcccaggttggagtgcagtggcgcaatgtcagctcactgcaacctccacgtctcgggttctagcgattctcctgcctcagcctcctgagggactataggcatgtgccaccatacctggttaagtttttttgtatttttagtagagacggggtttcactgtgttagccaggatggtctcgatctcctgtccttgtgatctgtccgcttaggcctcccaaagtgctgggattacaggcgtgagccactgctcccggctaaatcacaatttaaaacaagttatttactaaacag

SEQ ID NO: 184880 - DNA, 1307 bp, Homo sapiens
  Payload ID: 16403
  Gene Symbol: SRI
  Gene Name: sorcin
  ENST ID: ENST00000419179
  CDS Start-End: 11-487
agtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacacttta

SEQ ID NO: 184881 - DNA, 769 bp, Homo sapiens
  Payload ID: 16403
  Gene Symbol: SRI
  Gene Name: sorcin
  ENST ID: ENST00000457606
  CDS Start-End: 40-258
ggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaacttgttcgtctgtgataaggttgagagaaacagctggaggtagggctttccttctaggtccattatattgtatgtttctgtgagaagaaaagatgtttgaggcattctagtagaatgaacagaagagaagaaaaagagtaaagcttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatgtaagtcttagaaattaa

SEQ ID NO: 184882 - DNA, 570 bp, Homo sapiens
  Payload ID: 16403
  Gene Symbol: SRI
  Gene Name: sorcin
  ENST ID: ENST00000490437
  CDS Start-End: 63-530
actctgcaagaaggcaatcctctaaggatcaccagcttctacctataagacttcaactcaagatgcaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaact

SEQ ID NO: 184883 - DNA, 7028 bp, Homo sapiens
  Payload ID: 16404
  Gene Symbol: SORT1
  Gene Name: sortilin 1
  Uniprot ID: Q99523
  ENST ID: ENST00000256637
  CDS Start-End: 60-2555
ggcgggggtgggcgggcgcgccgggcggcaggtgtcggcgtcggcggcattcggcggcgatggagcggccctggggagctgcggacggcctctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcaaagctgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttttgtttttgttttttaagggaaacgaaatggaattcgaagggaccttttcactaaccccacttctgtgtgttctgcatggcgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctac

SEQ ID NO: 184884 - DNA, 6993 bp, Homo sapiens
  Payload ID: 16404
  Gene Symbol: SORT1
  Gene Name: sortilin 1
  Uniprot ID: Q99523
  ENST ID: ENST00000538502
  CDS Start-End: 434-2518
aaacttatgatgaataaagccaggaactcttgcttattttctgtcctccctctgctcctgtcactaactacttctgtaaacataacttcccaacttctactccaactttaaagcatctggttccttaaataaacaggccctgtagagaggccgtgttgtatggggtgtcagctctgggaagaatgcgtgtgtttgtttgctggctctggcagggttgagtccaagctgacaggactgagtgtgcctgtcagaggcttcagggagctgccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagcagtatgtttggccaaatggggatcagacaacaccatcttctttacaacctatgcaaatggctcctgcactgaccttggggctctggaattatggagaacttcagacttgggaaaaagcttcaaaactattggtgtgaaaatctactcatttggtcttgggggacgtttcctttttgcctctgtgatggctgataaggatacaacaagaaggatccacgtttcaacagatcaaggggacacatggagcatggcccagctcccctccgtgggacaggaacagttctattctattctggcagcaaatgatgacatggtattcatgcatgtagatgaacctggagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaagataattctatccagaccatgatcacttttgaccaaggaggaaggtggacgcacctgaggaagcctgaaaacagtgaatgtgatgctacagcaaaaaacaagaatgagtgcagccttcatattcatgcttcctacagcatctcccagaaactgaatgttccaatggccccactctcagagccgaatgccgtaggcattgtcattgctcatggtagcgtgggggatgccatctcagtgatggttccagatgtgtacatctcagatgatgggggttactcctggacaaagatgctggaaggaccccactattacaccatcctggattctggaggcatcattgtggccattgagcacagcagccgtcctatcaatgtgattaagttctccacagacgaaggtcaatgctggcaaacctacacgttcaccagggaccccatctatttcactggcctagcttcagaacctggagctaggtccatgaatatcagcatttggggcttcacagaatctttcctgaccagccagtgggtctcctacaccattgattttaaagatatccttgaaaggaactgtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctgtgattttggctactaccgtccagaaaatgactccaagtgtgtggaacagccagaactgaagggccacgacctggagttttgtctgtacggaagagaagaacacctaacaacaaatgggtaccggaaaattccaggggacaaatgccagggtggggtaaatccagttcgagaagtaaaagacttgaaaaagaaatgcacaagcaactttttgagtccggaaaaacagaattccaagtcaaattctgttccaattatcctggccatcgtgggattgatgctggtcacagtcgtagcaggagtgctcattgtgaagaaatatgtctgtgggggaaggttcctggtgcatcgatactctgtgctgcagcagcatgcagaggccaatggtgtggatggtgtggatgctttggacacagcctcccacactaataaaagtggttatcatgatgactcagatgaggacctcttggaatagctcttcagaggagctggacccagcatggatggtggaaccacagtacctcttacactccctgtggctccaacttcaggaaataaatttcccattgcgagggacccagctctgtttctgctgcttccatcaaagccaaaaggacctacactaaagaaatgcagggtgggggtggggaaccctgagcacttttttacaattggctctgagaaaaagggagacattttaaattctttaacttcttatttctcgtcctgtctctttgcaaagtatgggcttttttgtttttgttttttaagggaaacgaaatggaattcgaagggaccttttcactaaccccacttctgtgtgttctgcatggcgcctgccccagggcatctgccaactccagtatcagctctcacagtgtacttggtaccatccctgggctctgctggcgagacgaaacagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttttttttttttatttgaagtgccaaattaactttagtcagaatgtgagcagatggctaagttctctcctccccagaatggattaacagctgcgtggaaagtgggggagagagtggatggagacttttagagatgttaaaactgcagtagaatgaaatgagtcagggagcttcagttagaaaataaagttgaggcagtttttgtgaagataatatggttagggctggagtgcactagtctttttgcttattcattttgcatggttttaaaattaaaaataattccgaagatacaccagctcacaaatgaaaacgtcagcctctgccccaccctccctcctgcccaaagtgaatttggtactcagaaaagaactgtttataccactcacctttctcccagcatgtactcactgtgggcagatgcaccaatacatggtaatcctcttactcattttaagacgtaggaaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctactg

SEQ ID NO: 184885 - DNA, 469 bp, Homo sapiens
  Payload ID: 16404
  Gene Symbol: SORT1
  Gene Name: sortilin 1
  ENST ID: ENST00000471996
  CDS Start-End: 1-314
tctcgcgctggccccatggcctcggcctcctcctcctcctgcagctgctgccgccgtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccagttgtcaaaatctcttgaacatcgtttttcgtctgtataaataatcaggacccagtaacgctgttaggccccaggaaggtgaaggagtaattaactcttgagcgcttgcagaagttgggctgcgcagaagcaaagcatgtgtttgatgatctcagaggctcagtatccttgtcctgggttggagatagcactggg

SEQ ID NO: 184886 - DNA, 615 bp, Homo sapiens
  Payload ID: 16404
  Gene Symbol: SORT1
  Gene Name: sortilin 1
  ENST ID: ENST00000482236
  CDS Start-End: 434-615
aaacttatgatgaataaagccaggaactcttgcttattttctgtcctccctctgctcctgtcactaactacttctgtaaacataacttcccaacttctactccaactttaaagcatctggttccttaaataaacaggccctgtagagaggccgtgttgtatggggtgtcagctctgggaagaatgcgtgtgtttgtttgctggctctggcagggttgagtccaagctgacaggactgagtgtgcctgtcagaggcttcagggagctgccgctgaagacctcggcctgttgttgtgaatcgccagacctttgtaacacccggaagtctgaagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaat

SEQ ID NO: 184887 - DNA, 583 bp, Homo sapiens
  Payload ID: 16404
  Gene Symbol: SORT1
  Gene Name: sortilin 1
  ENST ID: ENST00000493736
  CDS Start-End: 228-583
agacatgaggctagagctggaggaaccagaggtagaaatggggagccaagaagagttcccctttcagaggccggccattgctttggtcttggatgtgaaggtcccagaggaaagcagaacagaagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggatattacagatctcatcaataacacctttattcggactgaatttggcatggctattggtcctgagaactctggaaaggtggtgttaacagcagaggtgtctggaggaagtcgtggaggaagaatctttagatcatcagattttgcgaagaattttgtgcaaacagatctcccttttcatcctctcactcagatgatgtatagccctcagaattctgattatcttttagctctcagcactgaaaatggcctgtgggtgtccaagaattttgggggaaaatgggaagaaatccacaaagc

SEQ ID NO: 184888 - DNA, 561 bp, Homo sapiens
  Payload ID: 16404
  Gene Symbol: SORT1
  Gene Name: sortilin 1
  ENST ID: ENST00000633956
  CDS Start-End: 501-561
atttcttccaatacttggcctctcttcatcctaccttccctagcacccccagccgtctagcttatttaatagtctcttgagttctgtttcttccattcagctttggatcaaggagtaggaactctgtaggatctccttcttggtcctggttgagcagagtgagcgaaaccttcatgaagagtcttctctcatgcaatgtatagtcagacctttagcccctagagggatgttaaaatgacttatgcattggatatttcagtaagaagtatcagcagatttgatgaagtgtaatttatctggggaaaggttagtcttcatctgaagtttggttgggatgagagtagaaagctagccaggtatgacagatggctccaagggaatgcagtgttaacaattagcatgtgtttgatgatctcagaggctcagtatccttgtcctgggttggagatagcactggggtcattctagtcttgactaccttccatgtaccactggtaattatgacttttggacagtccaagctatatcgaagtgaggattatgggaagaactttaaggata

SEQ ID NO: 184889 - DNA, 10904 bp, Homo sapiens
  Payload ID: 16405
  Gene Symbol: SORL1
  Gene Name: sortilin-related receptor, L(DLR class) A repeats containing
  Uniprot ID: Q92673
  ENST ID: ENST00000260197
  CDS Start-End: 130-6774
cccggagcggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatcc

SEQ ID NO: 184890 - DNA, 3692 bp, Homo sapiens
  Payload ID: 16405
  Gene Symbol: SORL1
  Gene Name: sortilin-related receptor, L(DLR class) A repeats containing
  ENST ID: ENST00000532694
  CDS Start-End: 382-3564
acagaaagtcccgagttatgtttcctccgttttgggagctcagcactgattttactctctctgactgagcatctcacggtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagaggcaagcagctctaagggtctgagggtctcagaatctcagcccacctgtaacccatttgcagcacactgactggaagctgttaaatgaccttttgtccctgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaac

SEQ ID NO: 184891 - DNA, 3836 bp, Homo sapiens
  Payload ID: 16405
  Gene Symbol: SORL1
  Gene Name: sortilin-related receptor, L(DLR class) A repeats containing
  ENST ID: ENST00000525532
  CDS Start-End: 239-3715
agtctgatctggctgaagacaggatgcaagtcactggttatactgagcagaagttttcagcacagtaggcgccccaaagcttgccacttgacccttgagagcttctcgctgtcctttccgaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaac

SEQ ID NO: 184892 - DNA, 3032 bp, Homo sapiens
  Payload ID: 16405
  Gene Symbol: SORL1
  Gene Name: sortilin-related receptor, L(DLR class) A repeats containing
  ENST ID: ENST00000527934
  CDS Start-End: 422-2911
aaagtatggtttgcaaccagtagcatctgcatctccttggaacttgttagaaatgtagaatctctgacctcaccccagacctacagagtcagaatctgcatgctaataagcccccaggtcctgtgtgctccacaatgcatttgaggagcactcatgtggaatgcagacttgcccctttcctttctggcattctcatctctgaaccaggtcgtggagtagttgcggttgaattaactagaacacaatgctttgcctcagtaggaattctcttagccaccctgtgcctcctcagccacctgtttctttcaccagcccctgcaaaagcaaacttatctgaatattaaccgaaatcaaatatagtaagggaaatctactccccaaaagggaaaagaatattgcctcttctgacaacccattatacatgatttctagattagccgctgctcagagctgtgccagtcactggcctccctcagcagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaac

SEQ ID NO: 184893 - DNA, 3501 bp, Homo sapiens
  Payload ID: 16405
  Gene Symbol: SORL1
  Gene Name: sortilin-related receptor, L(DLR class) A repeats containing
  ENST ID: ENST00000534286
  CDS Start-End: 12-3386
gtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagagaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggcc

SEQ ID NO: 184894 - DNA, 7272 bp, Homo sapiens
  Payload ID: 16406
  Gene Symbol: SORCS1
  Gene Name: sortilin-related VPS10 domain containing receptor 1
  Uniprot ID: Q8WY21
  ENST ID: ENST00000263054
  CDS Start-End: 9-3515
ctcccgcgatgggaaaagttggcgccggcggcggctcccaagcccggctgagcgcgctcctcgccggcgcggggctcttgatcctctgcgccccgggcgtctgcggcggcggctcctgctgcccctcgccgcaccccagctccgctccacgctcggcctcgacccctaggggcttttcccaccaggggcggccaggcagggctcctgccacgcccctgcccctcgtagtgcgtcccctgttctcagtggcccccggggaccgagcgctatccctggagcgggctcggggcactggggcatccatggcggttgctgcacgctccggccggaggagacggagcggagcggatcaggagaaggcagaacggggagagggcgcgagtcggagcccccggggagtgctaagagatggagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaacaaaacataaaatataaacaatcaaaatccaaacaaacaaacaaacactcactgcatcgggactttttaattcttcagacacagacaacaagggtttttagctttaagcctgtgcatgtggacaatactctgagaacatgtctggaggggcagtgtacaggtgctctattttaatggaaaacactcccctctccctctttcttcttctctctcttttttctgatcggtcgtgtttgtagaaaattcataacatatataggccaaggaaatctgcatgtatttttggaaatattcttggctctagatttatcagctattttagcattaaaggctgatgggtggattagctaccccagctcctttcataagacacaaagacgtgcacaggagtttgaaaccctgagctgtttctctgttccactttccatactgtcatttcccttctaagttagctttggtagctctgttggtcagcagtggccacaaggctgctttctgcactctctgtggccacaggaacaaagatgcgagttgaagatccctttgtgccggtagaataaggaaggaagggaggcagggaggcaaagcatgtcagaaacggaccttggtttcctgttcacctctttccaccatgattgcctccccttgcagctttccctactcctgccccaactgcagtaggaaatggaatcccattagttacccattgtcctgtcttcacatttgtttgtcatccatgtgtgaccatgatctgttgatatctttgaatctcttccctccaaaccccaagtaagttgtccttcaactgttctcagtttttcttcccaaacatattgctagattctggacattaaccctgacgtttcctaaatactggcctggcctgtgccgcccctgcccccactactcacaagtttctgagccctttgtcagttttgtacattcccaagcatgccagcttctgtgcccatggaccttgctgcatcctgcacagcagggttcagtttcatgtatctttgtcttttcctctagaacctgcctttttcaaatatccctgccttttcccacctggaaacatatactgtatgcgaaagagttgatatatgcaaagtaattcaaacctggccatgtactttggaaaagaaagcatagagatgaattgtggtgttctcacaccttaacgaaaatctcgtgcgatctgattccagaagattcttgtgagaaatgttttgaatgtgtgacaatttcgcagggcaatttcctcctgtgacggttgctgttacctggtatttccactctcacagtagaatagaaatgtttgtgaaataaaactgattttaactggaaggagaaacaggttaatggactttgtgtttaagagtgtcaaacagtctgagagaataaatgggggtcttgtcttacattagggtgagagtttgattatttaggatgatcccagtgatttcatgtgtgctctctgacctctgagtatcatagtatcattaaagtaaagatttaagtctgtataaaggaggagagttactgattggcaaaaaagattggcacaaagcatgaagaaaccccatttttcccagggtaatcatgaaagaaggctcagagaaagagggaaacaaaagcctgttcagcagaggcccctttagtattatggactgggcaaagcccactataaactataggagaaagaagttctgataaacctcttagtatgctcagcctccttctttgctatgtccctaagccaacagggtataacacaggccctggtgataatgagggtgtcctaaagatcctgatgtccatgacttcatgtagttcaggcacagaaagaatagcaaagctgctgtcagaagtttgtcaggcagagatgtttatggttgaggataccccatatgaatctgggaaatgggctaggcctgaggcagtcacctatttgtagaactcaattgatccccaacctgccaggcttcctatctcataggaaacatcctcattgatcctcttcagttggagtctcccaaatttaatgtggaagacaaagtgttggaaaatcaaaagaggctcactcaaaccagcacagggagtcctcagagttgcagttcaattcattttaattagaaaagtatgaaagaggtataacactcttattctagcacagtgccttgcctagagtagtagtatgaaaactatttgttgaagaaataaatgaatggaaagacatagggaagaatgggctgtaaatcctaattaaaaatagaggtcgacatgagatacctggcattttgggaagtgaccaaagatggccagctagagattcagcatctccaggatcctcatgtgcctctcctcaaagctccctcccatctgtaggagattagtgaggcaaggtgctgctcagagaggaggacctcattgttcttaggaccttggccagttgttctcaaagtgtggtacctggatcagcagtatcactatcacttgggctagttagagatccagattctggatccataccccatacctactgaattagaaactctaggggatgaatagtggtgttctctgttgctaagtgacagtgggcccagccacctattttaacaagccctcccagtgattgtgatacatactaaagtttgagaaccattgtactaggccattccagctgaatctcaaacagaaggcagtaatgagagcctacaaatgggagggacctaagtgcctacctactcgctaatcgcaggtgcaaacacacaaggagtttggtgggcttaaggtcagaggagtgtgtagggagggatgtatgtggaaggtaagattcagggcaagctaaaaatccgatactgcaacgttttccaaaatcccagaaggcaaactgtgcatgttctaccctgaaccacccaagcaacactttctaccttgccttatttttaattggattcactgtccaaaatgcagaggtttgctttgcttttttttcagaagttccaaacagcaactttgagagcagtggggtgcttggcagctgttctgtgttttccaggaatccaactgagcattgaaatctctcatttgccgacttatttttataggaagccaattaaaaaaaaaaaaagttttcttatagtattggaactacttctaattttaaaatgacttttttgatgtattttttgttaaatactatgtagtgtaatgtataattgctcttgtttattgcttttacaatcatatttattaaacagataatgtctctaaagtctttgcctcaggtatttttttttttaatcctaaacccttggtgttcattctaaatatagaagtgttgcatgtataggatttcataaaggctaattgcataagaaagagtaaacaccacaggcttgaggtttttggctgttttttactaacaaggcagaatgtatgtactacctgaattctacctgcatttcaattaactatacaatgtctgtttattaaattactttgatttaaaaatta

SEQ ID NO: 184895 - DNA, 3009 bp, Homo sapiens
  Payload ID: 16406
  Gene Symbol: SORCS1
  Gene Name: sortilin-related VPS10 domain containing receptor 1
  ENST ID: ENST00000344440
  CDS Start-End: 172-3009
caggtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggaagatatcgcagcacattgcaaagtctctga

SEQ ID NO: 184896 - DNA, 2638 bp, Homo sapiens
  Payload ID: 16406
  Gene Symbol: SORCS1
  Gene Name: sortilin-related VPS10 domain containing receptor 1
  ENST ID: ENST00000369698
  CDS Start-End: 128-2272
gttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaa

SEQ ID NO: 184897 - DNA, 663 bp, Homo sapiens
  Payload ID: 16406
  Gene Symbol: SORCS1
  Gene Name: sortilin-related VPS10 domain containing receptor 1
  ENST ID: ENST00000452214
  CDS Start-End: 1-641
acctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggaagtatttccatagttgctgagaatcaaagcacaaaagaaatccctacctatgtaaatgtttgaatggaggacgccagtaaaaaaa

SEQ ID NO: 184898 - DNA, 6701 bp, Homo sapiens
  Payload ID: 16406
  Gene Symbol: SORCS1
  Gene Name: sortilin-related VPS10 domain containing receptor 1
  ENST ID: ENST00000622431
  CDS Start-End: 172-2952
caggtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaacaaaacataaaatataaacaatcaaaatccaaacaaacaaacaaacactcactgcatcgggactttttaattcttcagacacagacaacaagggtttttagctttaagcctgtgcatgtggacaatactctgagaacatgtctggaggggcagtgtacaggtgctctattttaatggaaaacactcccctctccctctttcttcttctctctcttttttctgatcggtcgtgtttgtagaaaattcataacatatataggccaaggaaatctgcatgtatttttggaaatattcttggctctagatttatcagctattttagcattaaaggctgatgggtggattagctaccccagctcctttcataagacacaaagacgtgcacaggagtttgaaaccctgagctgtttctctgttccactttccatactgtcatttcccttctaagttagctttggtagctctgttggtcagcagtggccacaaggctgctttctgcactctctgtggccacaggaacaaagatgcgagttgaagatccctttgtgccggtagaataaggaaggaagggaggcagggaggcaaagcatgtcagaaacggaccttggtttcctgttcacctctttccaccatgattgcctccccttgcagctttccctactcctgccccaactgcagtaggaaatggaatcccattagttacccattgtcctgtcttcacatttgtttgtcatccatgtgtgaccatgatctgttgatatctttgaatctcttccctccaaaccccaagtaagttgtccttcaactgttctcagtttttcttcccaaacatattgctagattctggacattaaccctgacgtttcctaaatactggcctggcctgtgccgcccctgcccccactactcacaagtttctgagccctttgtcagttttgtacattcccaagcatgccagcttctgtgcccatggaccttgctgcatcctgcacagcagggttcagtttcatgtatctttgtcttttcctctagaacctgcctttttcaaatatccctgccttttcccacctggaaacatatactgtatgcgaaagagttgatatatgcaaagtaattcaaacctggccatgtactttggaaaagaaagcatagagatgaattgtggtgttctcacaccttaacgaaaatctcgtgcgatctgattccagaagattcttgtgagaaatgttttgaatgtgtgacaatttcgcagggcaatttcctcctgtgacggttgctgttacctggtatttccactctcacagtagaatagaaatgtttgtgaaataaaactgattttaactggaaggagaaacaggttaatggactttgtgtttaagagtgtcaaacagtctgagagaataaatgggggtcttgtcttacattagggtgagagtttgattatttaggatgatcccagtgatttcatgtgtgctctctgacctctgagtatcatagtatcattaaagtaaagatttaagtctgtataaaggaggagagttactgattggcaaaaaagattggcacaaagcatgaagaaaccccatttttcccagggtaatcatgaaagaaggctcagagaaagagggaaacaaaagcctgttcagcagaggcccctttagtattatggactgggcaaagcccactataaactataggagaaagaagttctgataaacctcttagtatgctcagcctccttctttgctatgtccctaagccaacagggtataacacaggccctggtgataatgagggtgtcctaaagatcctgatgtccatgacttcatgtagttcaggcacagaaagaatagcaaagctgctgtcagaagtttgtcaggcagagatgtttatggttgaggataccccatatgaatctgggaaatgggctaggcctgaggcagtcacctatttgtagaactcaattgatccccaacctgccaggcttcctatctcataggaaacatcctcattgatcctcttcagttggagtctcccaaatttaatgtggaagacaaagtgttggaaaatcaaaagaggctcactcaaaccagcacagggagtcctcagagttgcagttcaattcattttaattagaaaagtatgaaagaggtataacactcttattctagcacagtgccttgcctagagtagtagtatgaaaactatttgttgaagaaataaatgaatggaaagacatagggaagaatgggctgtaaatcctaattaaaaatagaggtcgacatgagatacctggcattttgggaagtgaccaaagatggccagctagagattcagcatctccaggatcctcatgtgcctctcctcaaagctccctcccatctgtaggagattagtgaggcaaggtgctgctcagagaggaggacctcattgttcttaggaccttggccagttgttctcaaagtgtggtacctggatcagcagtatcactatcacttgggctagttagagatccagattctggatccataccccatacctactgaattagaaactctaggggatgaatagtggtgttctctgttgctaagtgacagtgggcccagccacctattttaacaagccctcccagtgattgtgatacatactaaagtttgagaaccattgtactaggccattccagctgaatctcaaacagaaggcagtaatgagagcctacaaatgggagggacctaagtgcctacctactcgctaatcgcaggtgcaaacacacaaggagtttggtgggcttaaggtcagaggagtgtgtagggagggatgtatgtggaaggtaagattcagggcaagctaaaaatccgatactgcaacgttttccaaaatcccagaaggcaaactgtgcatgttctaccctgaaccacccaagcaacactttctaccttgccttatttttaattggattcactgtccaaaatgcagaggtttgctttgcttttttttcagaagttccaaacagcaactttgagagcagtggggtgcttggcagctgttctgtgttttccaggaatccaactgagcattgaaatctctcatttgccgacttatttttataggaagccaattaaaaaaaaaaaaagttttcttatagtattggaactacttctaattttaaaatgacttttttgatgtattttttgttaaatactatgtagtgtaatgtataattgctcttgtttattgcttttacaatcatatttattaaacagataatgtctctaaagtctttgcctcaggtatttttttttttaatcctaaacccttggtgttcattctaaatatagaagtgttgcatgtataggatttcataaaggctaattgcataagaaagagtaaacaccacaggcttgaggtttttggctgttttttactaacaaggcagaatgtatgtactacctgaattctacctgcatttcaattaactatacaatgtctgtttattaaattactttgattt

SEQ ID NO: 184899 - DNA, 6862 bp, Homo sapiens
  Payload ID: 16406
  Gene Symbol: SORCS1
  Gene Name: sortilin-related VPS10 domain containing receptor 1
  ENST ID: ENST00000612154
  CDS Start-End: 172-2985
caggtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaacaaaacataaaatataaacaatcaaaatccaaacaaacaaacaaacactcactgcatcgggactttttaattcttcagacacagacaacaagggtttttagctttaagcctgtgcatgtggacaatactctgagaacatgtctggaggggcagtgtacaggtgctctattttaatggaaaacactcccctctccctctttcttcttctctctcttttttctgatcggtcgtgtttgtagaaaattcataacatatataggccaaggaaatctgcatgtatttttggaaatattcttggctctagatttatcagctattttagcattaaaggctgatgggtggattagctaccccagctcctttcataagacacaaagacgtgcacaggagtttgaaaccctgagctgtttctctgttccactttccatactgtcatttcccttctaagttagctttggtagctctgttggtcagcagtggccacaaggctgctttctgcactctctgtggccacaggaacaaagatgcgagttgaagatccctttgtgccggtagaataaggaaggaagggaggcagggaggcaaagcatgtcagaaacggaccttggtttcctgttcacctctttccaccatgattgcctccccttgcagctttccctactcctgccccaactgcagtaggaaatggaatcccattagttacccattgtcctgtcttcacatttgtttgtcatccatgtgtgaccatgatctgttgatatctttgaatctcttccctccaaaccccaagtaagttgtccttcaactgttctcagtttttcttcccaaacatattgctagattctggacattaaccctgacgtttcctaaatactggcctggcctgtgccgcccctgcccccactactcacaagtttctgagccctttgtcagttttgtacattcccaagcatgccagcttctgtgcccatggaccttgctgcatcctgcacagcagggttcagtttcatgtatctttgtcttttcctctagaacctgcctttttcaaatatccctgccttttcccacctggaaacatatactgtatgcgaaagagttgatatatgcaaagtaattcaaacctggccatgtactttggaaaagaaagcatagagatgaattgtggtgttctcacaccttaacgaaaatctcgtgcgatctgattccagaagattcttgtgagaaatgttttgaatgtgtgacaatttcgcagggcaatttcctcctgtgacggttgctgttacctggtatttccactctcacagtagaatagaaatgtttgtgaaataaaactgattttaactggaaggagaaacaggttaatggactttgtgtttaagagtgtcaaacagtctgagagaataaatgggggtcttgtcttacattagggtgagagtttgattatttaggatgatcccagtgatttcatgtgtgctctctgacctctgagtatcatagtatcattaaagtaaagatttaagtctgtataaaggaggagagttactgattggcaaaaaagattggcacaaagcatgaagaaaccccatttttcccagggtaatcatgaaagaaggctcagagaaagagggaaacaaaagcctgttcagcagaggcccctttagtattatggactgggcaaagcccactataaactataggagaaagaagttctgataaacctcttagtatgctcagcctccttctttgctatgtccctaagccaacagggtataacacaggccctggtgataatgagggtgtcctaaagatcctgatgtccatgacttcatgtagttcaggcacagaaagaatagcaaagctgctgtcagaagtttgtcaggcagagatgtttatggttgaggataccccatatgaatctgggaaatgggctaggcctgaggcagtcacctatttgtagaactcaattgatccccaacctgccaggcttcctatctcataggaaacatcctcattgatcctcttcagttggagtctcccaaatttaatgtggaagacaaagtgttggaaaatcaaaagaggctcactcaaaccagcacagggagtcctcagagttgcagttcaattcattttaattagaaaagtatgaaagaggtataacactcttattctagcacagtgccttgcctagagtagtagtatgaaaactatttgttgaagaaataaatgaatggaaagacatagggaagaatgggctgtaaatcctaattaaaaatagaggtcgacatgagatacctggcattttgggaagtgaccaaagatggccagctagagattcagcatctccaggatcctcatgtgcctctcctcaaagctccctcccatctgtaggagattagtgaggcaaggtgctgctcagagaggaggacctcattgttcttaggaccttggccagttgttctcaaagtgtggtacctggatcagcagtatcactatcacttgggctagttagagatccagattctggatccataccccatacctactgaattagaaactctaggggatgaatagtggtgttctctgttgctaagtgacagtgggcccagccacctattttaacaagccctcccagtgattgtgatacatactaaagtttgagaaccattgtactaggccattccagctgaatctcaaacagaaggcagtaatgagagcctacaaatgggagggacctaagtgcctacctactcgctaatcgcaggtgcaaacacacaaggagtttggtgggcttaaggtcagaggagtgtgtagggagggatgtatgtggaaggtaagattcagggcaagctaaaaatccgatactgcaacgttttccaaaatcccagaaggcaaactgtgcatgttctaccctgaaccacccaagcaacactttctaccttgccttatttttaattggattcactgtccaaaatgcagaggtttgctttgcttttttttcagaagttccaaacagcaactttgagagcagtggggtgcttggcagctgttctgtgttttccaggaatccaactgagcattgaaatctctcatttgccgacttatttttataggaagccaattaaaaaaaaaaaaagttttcttatagtattggaactacttctaattttaaaatgacttttttgatgtattttttgttaaatactatgtagtgtaatgtataattgctcttgtttattgcttttacaatcatatttattaaacagataatgtctctaaagtctttgcctcaggtatttttttttttaatcctaaacccttggtgttcattctaaatatagaagtgttgcatgtataggatttcataaaggctaattgcataagaaagagtaaacaccacaggcttgaggtttttggctgttttttactaacaaggcagaatgtatgtactacctgaattctacctgcatttcaattaactatacaatgtctgtttattaaattactttgattt

SEQ ID NO: 184900 - DNA, 5582 bp, Homo sapiens
  Payload ID: 16407
  Gene Symbol: SORCS2
  Gene Name: sortilin-related VPS10 domain containing receptor 2
  ENST ID: ENST00000329016
  CDS Start-End: 47-3010
aacaccacaggtgatcttgatcctgacgaagtactaccacgcagacatggggaaggttctggaaagttctctgtggcggtcatcagatttcgggacgtcctacaccaagctcaccctccagcctggtgtcaccaccgtcatcgacaatttctacatctgcccgaccaacaagaggaaggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgattgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctcctcctcctcagagtccagcaccaacaagtgctctgccaacttctggtttaacccattgtccccgcctgacgactgtgccctgggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaatttcatcaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctccctctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctggctggtgacatgctggctgggggtgaatccgaatgacagtgcagacgttctcccatccaccatgtctgagcttgggggaattgcctcatttcccctggaaaagaaacatggtccattagaggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacagggacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtgtctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagcttttgcctt

SEQ ID NO: 184901 - DNA, 6152 bp, Homo sapiens
  Payload ID: 16407
  Gene Symbol: SORCS2
  Gene Name: sortilin-related VPS10 domain containing receptor 2
  Uniprot ID: Q96PQ0
  ENST ID: ENST00000507866
  CDS Start-End: 110-3589
cctttctctgcgctctcgctcgcgctccccagcgccctcctgctctcccggccgcggtcccctcgtccgcgccgccccgccgccggctccgctgccgcccctggcgaccatggcgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagcccgggcgcctgggtcctcacgcccaactgacccgggtgccgcggagccctcccgcggggcgcgcggagcccggtggcggcgaggaccggcaggcgcgcggcacggagccaggcgccccgggtccgagtcccggtcccgctcctggtcccggcgaggacggcgcccccgccgcgggctaccggcgctgggagcgggcggcgccgctggccggagtggcttcgcgggcgcaggtctcgctcatcagcacgtcgttcgtgctcaagggggacgcgacgcacaaccaggcgatggtgcactggacgggcgagaacagcagcgtgatcttgatcctgacgaagtactaccacgcagacatggggaaggttctggaaagttctctgtggcggtcatcagatttcgggacgtcctacaccaagctcaccctccagcctggtgtcaccaccgtcatcgacaatttctacatctgcccgaccaacaagaggaaggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgattgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctcctcctcctcagagtccagcaccaacaagtgctctgccaacttctggtttaacccattgtccccgcctgacgactgtgccctgggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctccctctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctggctggtgacatgctggctgggggtgaatccgaatgacagtgcagacgttctcccatccaccatgtctgagcttgggggaattgcctcatttcccctggaaaagaaacatggtccattagaggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacagggacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtgtctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagc

SEQ ID NO: 184902 - DNA, 762 bp, Homo sapiens
  Payload ID: 16407
  Gene Symbol: SORCS2
  Gene Name: sortilin-related VPS10 domain containing receptor 2
  ENST ID: ENST00000505529
  CDS Start-End: 1-306
cagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggtgaggagtttatagatgatgatctcgactcgcagactctaggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgc

SEQ ID NO: 184903 - DNA, 5530 bp, Homo sapiens
  Payload ID: 16408
  Gene Symbol: SORCS3
  Gene Name: sortilin-related VPS10 domain containing receptor 3
  Uniprot ID: Q9UPU3
  ENST ID: ENST00000369699
  CDS Start-End: 1-3669
atggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaactcctctgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 184904 - DNA, 5757 bp, Homo sapiens
  Payload ID: 16408
  Gene Symbol: SORCS3
  Gene Name: sortilin-related VPS10 domain containing receptor 3
  Uniprot ID: Q9UPU3
  ENST ID: ENST00000369701
  CDS Start-End: 228-3896
atcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 184905 - DNA, 458 bp, Homo sapiens
  Payload ID: 16408
  Gene Symbol: SORCS3
  Gene Name: sortilin-related VPS10 domain containing receptor 3
  ENST ID: ENST00000393176
  CDS Start-End: 1-458
gaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgactgactatgggtatgagagacatggggagagccagtgtgtcccagctttctggtacaatccagcatccccatcaaaggactgcagccttggtcaaagctaccttaacagcactgg

SEQ ID NO: 184906 - DNA, 3373 bp, Homo sapiens
  Payload ID: 16409
  Gene Symbol: SNX1
  Gene Name: sorting nexin 1
  Uniprot ID: Q13596
  ENST ID: ENST00000261889
  CDS Start-End: 22-1695
ttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcg

SEQ ID NO: 184907 - DNA, 8119 bp, Homo sapiens
  Payload ID: 16409
  Gene Symbol: SNX1
  Gene Name: sorting nexin 1
  ENST ID: ENST00000380285
  CDS Start-End: 24-332
gcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtcacatgactcagaatgttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcgaatgttcctcagtttggatttgtgtgatggttccgcatgactaggtgagggttttgcattctgggtgggaatatcacagaagcagtgtgtcgtcagtgcgtcgtaatcagcatataatgtcagttggtcccattaatgttgttaactctgttcaccgcttaggttggtgtctgccagatttcattttaaatttacgatttcctctttgtaatttacaagtaatttgtggggagatactttgagactatataagtattttgttcctcattcaccagttatatagtatcagttgattagtcttgtcccagttattactgtcatgattgaccaacatgatttcctaactccataatgccttctacatttattggttgacattctacatacaaagaaaaacatcctttctcaccatttatttattcacttgtttatcaatatggatgcagggattcctgttttactcagagttgcaagccattgctttgattttatcttgattctcaaattgtcccagatttatagcggcctcttgtgtgtttgtagcttgctcccatcatgttttgagtactttcttaccttctggcataacaagatgttccaggctcatcttgaatgttccctaccctagccctggaatcagccatttctccagggagtcttggttccttataatggagaatggtatttatttatttttatttgatttgattattattactatttttgagacagagtctcgctcttgtcgcccaggctggattgcaatggcacaatctcagctcactgcaacctccacctaccaggttcaagcaattctcctgcctcagccttccaagtagctgggattacaggtgcctgcccccacacccagctaatttttgcatttttggtagaaatgggggttttaccatgttggggaggctggtctcgaactcctgacctcaggtgatctgcccacctcaacctcccaaagtgctgggattacaggtgtgagccaccatacccagccagagaatgttatttagaaaccaagatctgggtgccaaatgtgctgcttgttactggaatgtcattgcctctaggctctcaccatacagtgcaaagagatgatagatagatagatagatagatagatagatagatagatagatgatagatatagatagatagatagattgattgatttgtagaaacaagataggttagagatacctgacataaatagatactaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaagcagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaa

SEQ ID NO: 184908 - DNA, 1869 bp, Homo sapiens
  Payload ID: 16409
  Gene Symbol: SNX1
  Gene Name: sorting nexin 1
  ENST ID: ENST00000560829
  CDS Start-End: 567-1481
gactgactcactcagtatccgtgataagttaaagatgaatcctgaaggggtaggggaaaggagatcttgagttctccagcacggagactctttacaattatttctccgcgggatccgctgacagccaacgtctttcttacttcctgatcggacaggaagtaggtttcagttgctgtgaaaagggatgtcatgggaagccagtgaggtagtcagagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 184909 - DNA, 550 bp, Homo sapiens
  Payload ID: 16409
  Gene Symbol: SNX1
  Gene Name: sorting nexin 1
  ENST ID: ENST00000559061
  CDS Start-End: 494-550
aggaagtaggtttcagttgctgtgaaaagggatgtcatgggaagccagtgaggtagtcagagtaaacatcagtctccaaagataactacatcccttcttcccatcaacaatggctccaaagaaaatgggatccatgaagaacaagaccaagagccacaggatctctttgcagggtctcactctgttgcccaggctggagtgcagtggtgtggtcatggctcactgcagccccgacctcccaggctcaagtgatcttcccacctcaaccttctgagtagctaggaccacagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcaga

SEQ ID NO: 184910 - DNA, 774 bp, Homo sapiens
  Payload ID: 16409
  Gene Symbol: SNX1
  Gene Name: sorting nexin 1
  ENST ID: ENST00000558040
  CDS Start-End: 1-387
ggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaagtgctgggattacaggcgtgagccaccacacccggccctaagttgttttcttaaagacctgaaggcatccacacagtaggcctgttaaggacaagtcccatttggatacccacctgacctggtaagcattggagcttctctgacccctgcaagacattctttccccagatgggcaggggttgcccagtggagtagtagcagaggctggaagacagaagcatctttggtgagtagctggggaccttaatggcagacatgaaaaactccacttgctgagaagccaccgccagcaccctggggacagctagcatatgaggcagggccacctcccttccagacctcgaggcctggagctcctgcccatcctggcttctgcctgttgccccagttcttggtccctcagctctcttcacagtgaacccctgttacttgagggacccaagtgtgtctttgtttcttgaacccc

SEQ ID NO: 184911 - DNA, 1326 bp, Homo sapiens
  Payload ID: 16409
  Gene Symbol: SNX1
  Gene Name: sorting nexin 1
  ENST ID: ENST00000560260
  CDS Start-End: 11-334
gtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagaggggcagcagataacttgccatccctgccttcttggtcttgtagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgaggtgagtccactgaggcagcccagccaggggtgttctgctggttccaaatgaacccagggcccatcccacccagaggtttggaaccccacagggggaagagcgctgattgagtctaaagggccgtggctgctgaggaagcctctgaga

SEQ ID NO: 184912 - DNA, 753 bp, Homo sapiens
  Payload ID: 16409
  Gene Symbol: SNX1
  Gene Name: sorting nexin 1
  ENST ID: ENST00000559389
  CDS Start-End: 1-334
tggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagggtctcactctgttgcccaggctggagtgcagtggtgtggtcatggctcactgcagccccgacctcccaggctcaagtgatcttcccacctcaaccttctgagtagctaggaccacagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatag

SEQ ID NO: 184913 - DNA, 850 bp, Homo sapiens
  Payload ID: 16409
  Gene Symbol: SNX1
  Gene Name: sorting nexin 1
  ENST ID: ENST00000560861
  CDS Start-End: 1-213
tgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcaggctggggagcagttgggaatcaggtctggaatactcctaaccaagaagttgcccagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctgg

SEQ ID NO: 184914 - DNA, 1374 bp, Homo sapiens
  Payload ID: 16409
  Gene Symbol: SNX1
  Gene Name: sorting nexin 1
  Uniprot ID: Q13596
  ENST ID: ENST00000561026
  CDS Start-End: 1-1374
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaa

SEQ ID NO: 184915 - DNA, 1971 bp, Homo sapiens
  Payload ID: 16409
  Gene Symbol: SNX1
  Gene Name: sorting nexin 1
  Uniprot ID: Q13596
  ENST ID: ENST00000559844
  CDS Start-End: 15-1583
gcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 184916 - DNA, 324 bp, Homo sapiens
  Payload ID: 16409
  Gene Symbol: SNX1
  Gene Name: sorting nexin 1
  ENST ID: ENST00000625244
  CDS Start-End: 1-324
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagacaagcttaccattgttcagaagcaaacagtttgcagtaaaaagaagatttag

SEQ ID NO: 184917 - DNA, 2546 bp, Homo sapiens
  Payload ID: 16410
  Gene Symbol: SNX10
  Gene Name: sorting nexin 10
  Uniprot ID: Q9Y5X0
  ENST ID: ENST00000338523
  CDS Start-End: 188-793
gcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaa

SEQ ID NO: 184918 - DNA, 2491 bp, Homo sapiens
  Payload ID: 16410
  Gene Symbol: SNX10
  Gene Name: sorting nexin 10
  Uniprot ID: Q9Y5X0
  ENST ID: ENST00000396376
  CDS Start-End: 129-734
atagttgaccagcttctgcaggggctcctcagtgagagaatggaggtgaggtcagggactcctgccttgcctctgccatcacttccagtgatgcctattcctaagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 184919 - DNA, 944 bp, Homo sapiens
  Payload ID: 16410
  Gene Symbol: SNX10
  Gene Name: sorting nexin 10
  Uniprot ID: Q9Y5X0
  ENST ID: ENST00000409838
  CDS Start-End: 219-572
actgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcagacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagt

SEQ ID NO: 184920 - DNA, 746 bp, Homo sapiens
  Payload ID: 16410
  Gene Symbol: SNX10
  Gene Name: sorting nexin 10
  ENST ID: ENST00000409367
  CDS Start-End: 225-710
ttaacacctactcatctttactgtgctacaaagattcaaactaagctatgatggaaaattttaaaaaacacacctatcacaatggctaaaataaaaaatagtgataatccccctggaaactgtaataggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaa

SEQ ID NO: 184921 - DNA, 429 bp, Homo sapiens
  Payload ID: 16410
  Gene Symbol: SNX10
  Gene Name: sorting nexin 10
  ENST ID: ENST00000412416
  CDS Start-End: 271-429
tttgagtcagcaaactccgcggcccgcaagcccggctcggcccggccctgctctgttctgcccggaggagccgcccattgatcgtgtcctgtgctgaagatgtttccggaacaacagaaagagttaacacctactcatctttactgtgctacaaagattcaaactaagctatgatggaaaattttaaaaaacacacctatcacaatggctaaaataaaaaatagtgataatccccctggaaactgtaataggcatttatttattcattaaatgatactaatggaaggcattggatgtatgaggcattcaagtcttacaagacagcctaagctgccctacaggagcttagcgtctgctagaggaggcctacaggaatttgtaagtgtctgggttcgagatcctaggattcagaaggaggacttctggcat

SEQ ID NO: 184922 - DNA, 2613 bp, Homo sapiens
  Payload ID: 16410
  Gene Symbol: SNX10
  Gene Name: sorting nexin 10
  Uniprot ID: Q9Y5X0
  ENST ID: ENST00000446848
  CDS Start-End: 263-868
gctgagcgcgggcgcggggccgctacgtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccgtaagtgacaagagacccgctgagggggcctcccctgcaccgcccagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtg

SEQ ID NO: 184923 - DNA, 823 bp, Homo sapiens
  Payload ID: 16410
  Gene Symbol: SNX10
  Gene Name: sorting nexin 10
  ENST ID: ENST00000416246
  CDS Start-End: 233-823
gtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggcatttatttattcattaaatgatactaatggaaggcattggatgtatgaggcattcaagtcttacaagacagcctaagctgccctacaggagcttagcgtctgctagaggaggcctacaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattat

SEQ ID NO: 184924 - DNA, 2361 bp, Homo sapiens
  Payload ID: 16410
  Gene Symbol: SNX10
  Gene Name: sorting nexin 10
  ENST ID: ENST00000619420
  CDS Start-End: 1-606
atgttgcctagagagatgaagaaagaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatc

SEQ ID NO: 184925 - DNA, 2315 bp, Homo sapiens
  Payload ID: 16411
  Gene Symbol: SNX11
  Gene Name: sorting nexin 11
  Uniprot ID: Q9Y5W9
  ENST ID: ENST00000359238
  CDS Start-End: 268-1080
ccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtattt

SEQ ID NO: 184926 - DNA, 2733 bp, Homo sapiens
  Payload ID: 16411
  Gene Symbol: SNX11
  Gene Name: sorting nexin 11
  Uniprot ID: Q9Y5W9
  ENST ID: ENST00000393405
  CDS Start-End: 355-1167
ccctcacccggcacctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcacaacagctcatggtcatgcatgagagagaagtggctggccacagccagagggaacagtaacagcccaggggcctttattttgggaaaggctgtcccgggctgttactgtctcttctggttataaagcagacatgtggccatcttttccgcagggttagagtgggctcctttctttttggaatccttttcttctcctttggtagcagctccctgcctccagggcttccgccaccagcgtctctgctgtgttgcgcagtgcagtggggtgcaagggctttgtttctgcctgcctgaaagagagggctctggggatggagatgagaaacaacacgctctccttcagacaatgaggcattctgtcctcctgctgccattcttcatctccactgagagccagagctggtaggagccgagtgccacaggcattctgcattgctctactcttaggtttgtgtgtgtgatccttcccctccctgtcgcccactcctccctcctctggctatcctaccctgtctgtgggctcttttactaccagcctatgctgtgggactgtcatggcatttagttcagagtggaggggctttggcctgaaataaaatgcaagtatttaagattgttgttgcaatttgtgtctaacaagctgtagcagagaaggagggagtgagcgctggcagtatttcctttcataaatcatgaatttatcagtgtggaaataatgcttcagaactgtgctctgtagccctcctgcattgtgtgtgcagctcaagttcaccactggaggaaggattgtcttccaaagagctgggatccaactcttctcacagttctgggcgtgaaccttgttaggtataatttacctgatgctgcttccatcctcgcagtctgtctgaggtgccaggtgctgaaagagaaataaagtttgtcaacaggcagatgcaaa

SEQ ID NO: 184927 - DNA, 1601 bp, Homo sapiens
  Payload ID: 16411
  Gene Symbol: SNX11
  Gene Name: sorting nexin 11
  ENST ID: ENST00000452859
  CDS Start-End: 594-974
attcgccgtccctcacccggcacctgcgtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagaccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactgggagtggttatgttgtatccccatcttggctggcttcagtttttgctgtagccctagagcactttgtttgtgggaggctggcctcttgcctacctccttgcatggacagggggatgaatatttactttcccacctccttgctttttctttcactgataccactgaatggaactggtgctgtgactcctgctgctggggatttatgtcccgagaccttagcctggctgagtggagcctgagacctgcac

SEQ ID NO: 184928 - DNA, 1200 bp, Homo sapiens
  Payload ID: 16411
  Gene Symbol: SNX11
  Gene Name: sorting nexin 11
  Uniprot ID: Q9Y5W9
  ENST ID: ENST00000580219
  CDS Start-End: 112-900
attcgccgtccctcacccggcacctgcgtgcactctccggcgtcccaaatgtttccttccaatgggcttttggtgtaggatgtcggagaaccaagaacaggaggtaagagtatggtctgcagagaacaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccag

SEQ ID NO: 184929 - DNA, 627 bp, Homo sapiens
  Payload ID: 16411
  Gene Symbol: SNX11
  Gene Name: sorting nexin 11
  ENST ID: ENST00000582481
  CDS Start-End: 96-627
aactttcggggttttccctggtaaagaatgataagaacagaggcatactaaccttgatcctgtatcctctgtccctcatcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagc

SEQ ID NO: 184930 - DNA, 965 bp, Homo sapiens
  Payload ID: 16411
  Gene Symbol: SNX11
  Gene Name: sorting nexin 11
  ENST ID: ENST00000583320
  CDS Start-End: 250-423
ggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccatatggagttttgctcttgttgcccaggctggagtgcagtggtgtgatctcggcttactgcaacctccgcctcccaggttcaagtgattctcctgcctcagcctcccaagtagctgggattacagaccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccag

SEQ ID NO: 184931 - DNA, 922 bp, Homo sapiens
  Payload ID: 16411
  Gene Symbol: SNX11
  Gene Name: sorting nexin 11
  ENST ID: ENST00000584335
  CDS Start-End: 160-922
gtgggcttgagcgtcagtagtggcactcgggatggtggcatcgctttacatcctagggagggactctcttaccacccgggattaaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatc

SEQ ID NO: 184932 - DNA, 1282 bp, Homo sapiens
  Payload ID: 16411
  Gene Symbol: SNX11
  Gene Name: sorting nexin 11
  Uniprot ID: Q9Y5W9
  ENST ID: ENST00000582104
  CDS Start-End: 115-903
atatggtggggcgcgggcggtgtcgctgtggggagctggtgctgttctcagatgtttccttccaatgggcttttggtgtaggatgtcggagaaccaagaacaggaggtaagagtatggtctgcagagaacaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccactg

SEQ ID NO: 184933 - DNA, 563 bp, Homo sapiens
  Payload ID: 16411
  Gene Symbol: SNX11
  Gene Name: sorting nexin 11
  ENST ID: ENST00000581298
  CDS Start-End: 47-563
attcctgttagcccgcagcagcaacctgctcagatgtttccttccaatgggcttttggtgtaggatgtcggagaaccaagaacaggaggaggtgattacagtgcgtgttcaggacccccgagtgcagaatgagggctcctggaactcttatgtggattataagatattcctccataccaacagcaaagcctttactgccaagacttcctgtgtgcggcgccgctaccgtgagttcgtgtggctgagaaagcagctacagagaaatgctggtttggtgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctgg

SEQ ID NO: 184934 - DNA, 1426 bp, Homo sapiens
  Payload ID: 16411
  Gene Symbol: SNX11
  Gene Name: sorting nexin 11
  ENST ID: ENST00000581705
  CDS Start-End: 337-477
gtgcactctccggcgtcccaagtgagtggaggggggatcccgactccagtccggggccttggccagcggagccgcgctattcggaagcgggaatcccactcagagcccgggcctgtaggggcggggcgtcccgggcacccgggattggggcgtctcccgtcgtgcaccggggcaccggcgactcacccggaaggagaagccgtgatctggctatatggtggggcgcgggcggtgtcgctgtggggagctggtgctgttctcaggagccagcctggatcatttgttggcagtacatattggctgaagtcagttttcatttcaagatgtttccttccaatgggcttttggtgtaggatgtcggagaaccaagaacaggaggaggtgattacagtgcgtgttcaggacccccgagtgcagaatgagggctcctggaactcttatgtggattataagatattcctccatgcctgttcctgaacttcctgggaagtcaaccttcttcggcacctcagatgagttcattgagaagcgacgacaaggtctgcagcacttccttgaaaaggtcctgcagagtgtggttctcctgtcagacagccagttgcacctattcctgcaaagccagctctcggtgcctgagatagaagcctgtgtccagggccgaagtaccatgactgtgtctgatgccattcttcgatatgctatgtcaaactgtggctgggcccaggaagagaggcagagctcttctcacctggctaaaggagaccagcctaagagttgctgctttcttccaagatcgggtaggaggagctctccctcaccgcctcccagtgaagaaaaggaccatttagaagtgtgggctccagttgttgactctgaggttccttccttggaaagtcccactctcccacccctctcctcaccattatgctgtgattttggaagacccaaagagggaacctccactcttcagtctgtgaggagggctgtgggaggagatcatgctgtgcctttggaccctggtcagttagaaacagttttggaaaagtgagctctgggttctgctctgagatggtcagagaagatgcgggccaggagacttactcaggtgggactgggcacagggcaggtatgtgggaggctgggctgcttagtgtcttctagtcacctctgcttgggctgattgacagaggtcagtcattacagccccttatgcctcttccatgggaacaaatactgtgcagatgtttgtaagttaaacataagacacaggggctgttgcttttgaacagaaccctatattactctcctgggatctgagtttctgcaggtcatttgtatgtaggaccaggagtatctcctcaggtgaccagttttggggacccgtatgtggcaaattctaagctgccatattgaacatcatcccact

SEQ ID NO: 184935 - DNA, 720 bp, Homo sapiens
  Payload ID: 16412
  Gene Symbol: SNX12
  Gene Name: sorting nexin 12
  Uniprot ID: Q9UMY4
  ENST ID: ENST00000276105
  CDS Start-End: 98-574
gctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgagacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgact

SEQ ID NO: 184936 - DNA, 2376 bp, Homo sapiens
  Payload ID: 16412
  Gene Symbol: SNX12
  Gene Name: sorting nexin 12
  Uniprot ID: Q9UMY4
  ENST ID: ENST00000374274
  CDS Start-End: 118-606
ccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagcaag

SEQ ID NO: 184937 - DNA, 2422 bp, Homo sapiens
  Payload ID: 16412
  Gene Symbol: SNX12
  Gene Name: sorting nexin 12
  Uniprot ID: Q9UMY4
  ENST ID: ENST00000622277
  CDS Start-End: 167-655
ttttgattgccatttccttgggacagcctgaagagagaatcgaaagaagttcttttcagtatggttgcataacatcgagtcggagattgtgaaatgtcctttgagaaaaatgtacgggcaggaagatgaataggtgtctgtttgattaaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaaggtgcgccagtaggagcccctctcaccacctgccctctactttcctgctgaaatgacattggtttttacactaagcctctctctgtctttgatctgaagttggctgcccatctcctggcctgatagactgtctggcattgtgctccctggtacctgactacaccatgtgggcactctgctaggatcctcttctctgaggagaggtgggaacccacaggcagatgccctttgcttggggttggggtgggtgggtggggggattagactggaaggcaatttcttgggcatttacccatgccagaaggctaacctggggggaggggggcgcttgtgctggtgaggcacttggatacatactgatgctgcaagttcaggggatttttcttactcttaggtttaaccaagaacactgagcagggaaaaaccctgcctttcctaactgcatgtattttttcctttttggaaaggtggtagagactcagaagctttccttgttttcttcaggcctgctcccagttttcttaacagtttcttttgttgctttctctctcccttgttgctttccatggcagtaatcctcctagagtccaagcagtctgttgtatggagcagggtgtgtgggttttctgggcccatcattatggctgcttcagagtcagaagaaagccatagggcagtaggggagctcctattgcctagcccctctccctttgtggctcccactctagctgcctatttttgctcatcagctggtgagtcagtatgggccagcagttctccctccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagggcagaagcacacaaaccaaccacacagtctctgacttctcctaagcactttgagttgttgaatggggctcaggggcaagagtttttgctgccctccccagcgtggtcacagggttattgaactgcctgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagattggagttttctatgcagggcactgtggaaaaggattgctgattctgactgaccctgatcagagagattaggattgtattttgacataggatttggaacccatctaaatgttgaagttccctgagacagctctccagctgctgagcctgcgccaggggctaagcagcccctaatgagaggctctgctccctttcccacctcgccaatgttgttgttgctgcctttttgatttgtatcctctgttatagacattttttaaaaacgatttcctctttcattgtgcacaagtgctgagagtctgaggccccatttctgctgtgtatatatatcctgactcggggcttttattcagcaaactgttcattcttctgtcagacaatgtcatattcaactctgttcatattaaaccactgtgaagc

SEQ ID NO: 184938 - DNA, 661 bp, Homo sapiens
  Payload ID: 16412
  Gene Symbol: SNX12
  Gene Name: sorting nexin 12
  ENST ID: ENST00000622259
  CDS Start-End: 143-661
gtgcgtgcgtgggcgcgcgtgcgcgccgccgccgcctgtgggttggctagttattttgcaagcgggaggggccgtgcgcgctcctgcctcaggcctctgtcccccaccccctttccccggtcccaggctctccttcggaaagatgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatcttcaagctaaaggagtcctgcgtacggcggcgctacagtgactttgagtggctgaaaaatgagctggagagagatagcaagattgtagtaccaccactgcctgggaaagccttgaagcggcagctccctttccgaggagatgaagggatctttgaggagtctttcatcgaagaaaggaggcagggcctcgagcagtttattaacaaaattgctgggcacccactggctcagaatgaacgctgcctacacatgttcctgcaagaggaggcaattgacaggaactacgtcccggggaagtctttctcacagtgttgtccaggctggagtgcagtggcgtga

SEQ ID NO: 184939 - DNA, 4146 bp, Homo sapiens
  Payload ID: 16413
  Gene Symbol: SNX13
  Gene Name: sorting nexin 13
  ENST ID: ENST00000409604
  CDS Start-End: 190-759
gatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactagagtctcgccctgtcgcccaggctggagtacaatggcgcaatctcggctcactgcaacctccgcttcctggaaccctgttttgtttaacaaaaccttggtctcactgtgtctcctagaatatgtaatttaaattctggctctgaaattacagggaattgtggtagtgatttgagaaccctttcagttctaaaatagtaagattctctggtcaggttgttactaatcttgatttcttttcaatcatgtttcctcccaaaacacacactaacatactccatcacactccacattttgaataccatttggggagttatttttttttaagtatataggattgctaattagagttaatttactttgggattaaagtactcttcatatctattgttttattagtaggggtcttatagtaggataacaaaatttatttaaaccttttaatatatttctaaatgatcagaaagaatgcttgattctaaacataaaatacatttactaatctcttctcgatgattaaaacccttgtatcaatgaaataaaaagtttttgtacaaccagactattgctgttctttatagaatgctgaaaacaataaatctgtagtgttatgagtttgattttttttaagttttctgaagtgtaagttctcccaccacgttcagttttaagctatcagcatgaagtcactgaacatggaaataggaagagatgtacacaattgtttgcctactccagctcacagttggagaggatacagctaagtgaagagggggcagaggcagatttgtaaacctgaagtaatgagttgtatttccttgtgtggttgctaatttagctcctatgaaagaattccccgtatatttttgaggactatggtagggggtactcatacattaactttaagttcaggaatgtttgtgaagaaggtcaaattagtttcattattttaatcaatactgacaactaaatccttaaagtggatgataaaaggagactctggagagatggttatggtaacatgtagtatttatgactgaattgacgtaggggggattgatttagtggattcaaaatgaagcttacaattctgtgcctttacaattttacccaaattcaatttcagcctgagtttttgacaccgttaacaaagtagttcttcaaggactctgaaggatggaaacaagtaaaggattatgtatttagagtgaagagtagtatatcctttctaatagtgaattaagagggggacttagtatctgattcagagactcaggagaaggaatttttttctttcacagataagccactcagttgctttctctcaacaaaaaaaagtctgagtcagttgatcaaaaggccttctaatggagtaaaacttttctcaaaatctactcaaagttacttgtcaaaaatctacccaagaaaactaggaattctattttaatgatttttcaaaaatttctattttttttacatagaagataaagaccttttgttgaagattaatacatattattataattttatgtgattggttattatattgatcttattaacatacctttaaaaaggccaactcttaacgtgcgtgtgtgtgtgtgtgtttgtgtatgtgtatatgtatataccttttcccttgagattcctttcagttctaaaatactaagattctatggacctctgtgtgtgtgtgtgtgtgtgtgtgttgtacatatagtgtctatgtatacctacacattatgcagtatatagtatactctaccattcttactgtttttaaaaaaggtcttcgtagtcatttctctgaaaaactaatgtggcatcaggagcataacatttattataggattgttttctgtggaaaaagcagcttttacttttatcattttgacataaggcaccttttccaggaaaatattctgccatgaatgtgaagatcgcctttactgccaagcgatcaccctctcctctagtcaggcaagtctacaagatgacccttgcatatatatttatcatgctcatccccctcttctgctcattcctgtgtcctttcttctcccatataaatactgctctttcatcaagatttaagtgtagcctctttaatgaagcctctttaaattatgacatattccttaatctatagtctttgtgtgtgtggttctcgtcaacaaaattttaagctgattttgaaatggttcctattctgtgctattgcagtgaaagttctcttaactgatgtttggttagccagtgctctccattccctttgtatgctgtactgactgataaccttagcattaagactaggctctattacatctatccacttctgtttccacccttggagttgtatgcttatcaaaagtcagttgtgtgatacctggaccccacctccagaaaatctgatacaattagtctgtagtgtgacctgaatattggtgatttagaggagacagataatcaaacacgttgaaataaaagttgtatttgtttttgagcctaaatatcccagttacactttttatgataatcaggtcgtttaattaacagtcaacttagattgaagaaatatgaatatgacaaggtagtttctatgaaaaccaagtcacttgctttggaattactcgcagctggttgaagagtgtaattgaattaagtgagcgaaaggcagctatgaaatttgaaagtcttcaaggactctgcatgcagatttgttcacaaatgtctttattgccatgccattttaaagaaactggaaaccataggttttgcagtgtaggaacagttcatagttttttcaagacccaggtcatgttaataccactcagcagagccttaaccaaagaaaaagtcttattcctacacaggaagatttatataattgaacttaaagtgaaatatattcatggctccctcttttgatcgaatgtttaaatttacctactgcccaattaccagttttttatacactccatccctgtgtatgtatatgtgtggttttatgtagctaatataatcatagactcaaagatgtaatgagtgttgttagagaaaacaaactttgggaaatgatgtgacttgctgaatttcatagactggcactgatgcctttgatttgagtaaaagacccatcatttgggggagtcttttgttagaatcaaaggcatctgtgtcagtccagtgcgttttccagaaatacttgattttggtagtgttttgtgctactgatgatgagctgtacactgcttagaatagatggaacaagtgaggcaatttacaatcctaaactcaaccacatatttgggcctttacttgcctttttaagggattggcattaagtagccatgggacaaaaagagcttctcagtacatattctactttaacactttaaggagtaaggaagcaattgttgtttgtgcctcctgttgccattgtccaaacacccattgtaaacagtgctccgaccctgaaaaaggaatcaataaatcaatatgcattgagtgcctctaataa
